United States Patent
Gabor et al.

(10) Patent No.: US 11,261,218 B2
(45) Date of Patent: Mar. 1, 2022

(54) **SPECIES OF GENUS *PSEUDOMONAS***

(71) Applicant: BRAIN AG, Zwingenberg (DE)

(72) Inventors: Esther Gabor, Zwingenberg (DE);
Renate Schulze, Bensheim (DE);
Arnulf Kletzin, Darmstadt (DE)

(73) Assignee: BRAIN AG, Zwingenberg (DE)

( * ) Notice: Subject to any disclaimer, the term of this patent is extended or adjusted under 35 U.S.C. 154(b) by 0 days.

(21) Appl. No.: 16/646,458

(22) PCT Filed: Sep. 17, 2018

(86) PCT No.: PCT/EP2018/075071
§ 371 (c)(1),
(2) Date: Mar. 11, 2020

(87) PCT Pub. No.: WO2019/057664
PCT Pub. Date: Mar. 28, 2019

(65) Prior Publication Data
US 2020/0216503 A1 Jul. 9, 2020

(51) Int. Cl.
*C12N 1/20* (2006.01)
*C07K 14/21* (2006.01)
*C22B 3/18* (2006.01)
*C12R 1/38* (2006.01)

(52) U.S. Cl.
CPC .............. *C07K 14/21* (2013.01); *C12N 1/205* (2021.05); *C22B 3/18* (2013.01); *C12R 2001/38* (2021.05)

(58) Field of Classification Search
CPC ........... C07K 14/21; C12N 1/20; C12N 1/205
See application file for complete search history.

(56) References Cited

FOREIGN PATENT DOCUMENTS

| EP | 0432935 A1 | 6/1991 |
|---|---|---|
| WO | 2019057664 A1 | 3/2019 |

OTHER PUBLICATIONS

Faramarzi, Mohammad A. et al., "Metal solubilization from metal-containing solid material by cyanogenic Chromobacterium violaceum". Journal of Biotechnology, 2004, vol. 113, pp. 321-326.
Chi, Tran D. et al., "Bioleaching of gold and copper from waste mobile phone PCBs by using a cyanogenic bacterium", Minerals Engineering, 2011, vol. 24, pp. 1219-1222.

*Primary Examiner* — Tekchand Saidha
(74) *Attorney, Agent, or Firm* — Wolter VanDyke Davis PLLC; Michael Byrne (57) ABSTRACT

The present invention relates to a species of genus *Pseudomonas* identified as *Pseudomonas* BR11571, termed *Candidatus Pseudomonas metallosolvens*, having Accession Deposit Number DSM 32538.

14 Claims, 7 Drawing Sheets
Specification includes a Sequence Listing.

| Accession number | Species name | Strain | | Risk group | Similarity [%] BR11571 |
|---|---|---|---|---|---|
| | | BR11571 | | | 100.00 |
| NZ_CP015852 | Pseudomonas koreensis | CRS05-R5 | | | 97.33 |
| FN554194 | Pseudomonas koreensis | DSM16610T | Type strain | R1 (TRBA 466, 31.03.2017) | 97.19 |
| CP014947 | Pseudomonas koreensis | D26 | | | 96.89 |
| CP000094 | Pseudomonas | Pf0-1 | | | 96.59 |
| FN554206 | Pseudomonas moraviensis | DSM16007 | Type strain | R1 (TRBA 466, 31.03.2017) | 95.85 |
| HG940516 | Pseudomonas helmanticensis | OHA11 | Type strain | R1 (provisional classificaton by DSMZ) | 95.85 |
| HE800470 | Pseudomonas baetica | CECT 7720 | Type strain | R1, t2 (TRBA 466, 31.03.2017) | 95.26 |
| HG764749 | Pseudomonas granadensis | F-278,770 | Type strain | R1 (provisional classification by DSMZ) | 94.22 |
| FN554191 | Pseudomonas jessenii | CIP 105274 | Type strain | R1 (TRBA 466, 31.03.2017) | 93.48 |
| FN554231 | Pseudomonas umsongensis | LMG 21317 | Type strain | R1 (TRBA 466, 31.03.2017) | 93.19 |
| FN554232 | Pseudomonas vancouverensis | ATCC 700688 | Type strain | R1 (TRBA 466, 31.03.2017) | 92.89 |
| FN554171 | Pseudomonas chlororaphis | ATCC 33663 | Type strain | R1 (TRBA 466, 31.03.2017) | 92.74 |
| D86016 | Pseudomonas fluorescens | IAM 12022 | Type strain | R1+, n (TRBA 466, 31.03.2017) | 90.67 |
| AB039455 | Pseudomonas asplenii | NCPPB 1947 | Type strain | R1, p (TRBA 466, 31.03.2017) | 89.63 |
| FN554185 | Pseudomonas fuscovaginae | LMG 2158 | Type strain | R1 (TRBA 466, 31.03.2017) | 89.48 |
| AB039457 | Pseudomonas agarici | NCPPB 2289 | Type strain | R1, p (TRBA 466, 31.03.2017) | 89.33 |
| FN554166 | Pseudomonas abietaniphila | ATCC 700689 | Type strain | R1 (TRBA 466, 31.03.2017) | 85.93 |
| FN554187 | Pseudomonas graminis | LMG 21661 | Type strain | R1 (TRBA 466, 31.03.2017) | 85.93 |
| FN554224 | Pseudomonas rhizosphaerae | LMG 21640 | Type strain | R1 (TRBA 466, 31.03.2017) | 85.48 |
| FN554198 | Pseudomonas lutea | LMG 21974 | Type strain | R1 (TRBA 466, 31.03.2017) | 85.04 |
| AB039386 | Pseudomonas aeruginosa | IFO 12689 | Type strain | R2, ht (TRBA 466, 31.03.2017) | 84.44 |

Fig. 3

| Accession number | Species name | Strain | | Risk group | Similarity [%] BR11571 |
|---|---|---|---|---|---|
| | | BR11571 | | | 100.00 |
| HG764747 | Pseudomonas granadensis | F-278.770 | Type strain | R1 (provisional classificaton by DSMZ) | 97.26 |
| GCF001654515 5295541 bis 5291468 | Pseudomonas koreensis | CRS05-R5 | | | 97.15 |
| FN554737 | Pseudomonas koreensis | LMG21318 | Type strain | R1 (TRBA 466, 31.03.2017) | 97.15 |
| CP014947 | Pseudomonas koreensis | D26 | | | 96.49 |
| HE800504 | Pseudomonas baetica | CECT7720 | Type strain | R1, t2 (TRBA 466, 31.03.2017) | 96.38 |
| FN554743 | Pseudomonas moraviensis | DSM16007 | Type strain | R1 (TRBA 466, 31.03.2017) | 95.94 |
| CP000094 | Pseudomonas | Pf0-1 | | | 95.72 |
| AJ717473 | Pseudomonas vancouverensis | CIP106707 | Type strain | R1 (TRBA 466, 31.03.2017) | 94.74 |
| AJ717447 | Pseudomonas jessenii | CIP105274 | Type strain | R1 (TRBA 466, 31.03.2017) | 94.30 |
| FN554763 | Pseudomonas umsongensis | LMG21317 | Type strain | R1 (TRBA 466, 31.03.2017) | 94.30 |
| FN554754 | Pseudomonas reinekei | CCUG53116 | Type strain | R1 (TRBA 466, 31.03.2017) | 94.08 |
| AJ717433 | Pseudomonas fuscovaginae | LMG2158 | Type strain | R1 (TRBA 466, 31.03.2017) | 94.08 |
| HG940518 | Pseudomonas helmanticensis | OHA11 | Type strain | R1 (provisional classification by DSMZ) | 93.86 |
| AJ717432 | Pseudomonas asplenii | LMG2137 | Type strain | R1, p (TRBA 466, 31.03.2017) | 93.75 |
| FN554741 | Pseudomonas mohnii | CCUG53115 | Type strain | R1 (TRBA 466, 31.03.2017) | 93.31 |
| AJ717451 | Pseudomonas fluorescens | CIP69.13 | Type strain | R1+, n (TRBA 466, 31.03.2017) | 93.31 |
| FN554742 | Pseudomonas moorei | CCUG53114 | Type strain | R1 (TRBA 466, 31.03.2017) | 92.98 |
| FN554755 | Pseudomonas rhizosphaerae | LMG21640 | Type strain | R1 (TRBA 466, 31.03.2017) | 92.00 |
| AJ717416 | Pseudomonas abietaniphila | CIP106708 | Type strain | R1 (TRBA 466, 31.03.2017) | 90.79 |
| AJ717477 | Pseudomonas agarici | LMG 2112 | Type strain | R1, p (TRBA 466, 31.03.2017) | 90.79 |
| AJ717429 | Pseudomonas graminis | CIP 105897 | Type strain | R1 (TRBA 466, 31.03.2017) | 90.02 |
| FN554738 | Pseudomonas lutea | LMG21974 | Type strain | R1 (TRBA 466, 31.03.2017) | 89.36 |
| AJ717442 | Pseudomonas aeruginosa | LMG1242 | Type strain | R2, ht (TRBA 466, 31.03.2017) | 86.95 |

Fig. 4

| Accession number | Species name | Strain | | Risk group | Similarity [%] BR11571 |
|---|---|---|---|---|---|
| | | BR11571 | | | 100.00 |
| HG940517 | Pseudomonas helmanticensis | OHA11 | Type strain | R1 (provisional classificaton by DSMZ) | 96.07 |
| HG764748 | Pseudomonas granadensis | F-278.770 | Type strain | R1 (provisional classificaton by DSMZ) | 93.21 |
| FN554490 | Pseudomonas moraviensis | DSM16007 | Type strain | R1 (TRBA 466, 31.03.2017) | 92.68 |
| FN678357 | Pseudomonas baetica | a390 | Type strain | R1, t2 (TRBA 466, 31.03.2017) | 92.32 |
| CP014947 | Pseudomonas koreensis | D26 | | | 91.79 |
| NZ_CP015852 | Pseudomonas koreensis | CRS05-R5 | | | 90.89 |
| FN554476 | Pseudomonas koreensis | LMG21318 | Type strain | R1 (TRBA 466, 31.03.2017) | 90.54 |
| CP000094 | Pseudomonas | Pf0-1 | | | 89.64 |
| FN554508 | Pseudomonas reinekei | CCUG 53116 | Type strain | R1 (TRBA 466, 31.03.2017) | 89.64 |
| FN554487 | Pseudomonas mohnii | CCUG53115 | Type strain | R1 (TRBA 466, 31.03.2017) | 88.93 |
| FN554489 | Pseudomonas moorei | CCUG53114 | Type strain | R1 (TRBA 466, 31.03.2017) | 88.75 |
| FN554473 | Pseudomonas jessenii | CIP105274 | Type strain | R1 (TRBA 466, 31.03.2017) | 87.86 |
| FN554516 | Pseudomonas umsongensis | LMG 21317 | Type strain | R1 (TRBA 466, 31.03.2017) | 87.86 |
| AB039563 | Pseudomonas agarici | NCPPB 2289 | Type strain | R1, p (TRBA 466, 31.03.2017) | 87.28 |
| FN554517 | Pseudomonas vancouverensis | ATCC 700688 | Type strain | R1 (TRBA 466, 31.03.2017) | 86.79 |
| AB039545 | Pseudomonas fluorescens | IAM 12022 | Type strain | R1+, n (TRBA 466, 31.03.2017) | 84.64 |
| FN554447 | Pseudomonas abietaniphila | ATCC 700689 | Type strain | R1 (TRBA 466, 31.03.2017) | 81.72 |
| FN554467 | Pseudomonas fuscovaginae | LMG 2158 | Type strain | R1 (TRBA 466, 31.03.2017) | 81.36 |
| AB039593 | Pseudomonas asplenii | NCPPB 1947 | Type strain | R1, p (TRBA 466, 31.03.2017) | 81.00 |
| FN554469 | Pseudomonas graminis | LMG 21661 | Type strain | R1 (TRBA 466, 31.03.2017) | 80.97 |
| FN554480 | Pseudomonas lutea | LMG 21974 | Type strain | R1 (TRBA 466, 31.03.2017) | 79.96 |
| FN554510 | Pseudomonas rhizosphaerae | LMG 21640 | Type strain | R1 (TRBA 466, 31.03.2017) | 76.34 |
| AB039607 | Pseudomonas aeruginosa | IFO 12689 | Type strain | R2, ht (TRBA 466, 31.03.2017) | 68.00 |

| Assembly accession | Species name | Strain | Risk group | ANIb [%] BR11571 |
|---|---|---|---|---|
| scaffold BR11571 (BRAIN AG) | | BR11571 | | 100.00 |
| LMG 28168 | Pseudomonas helmanticensis | LMG 28168 (T) | R1 (provisional classification by DSMZ) | 90.96 |
| GCF_000282235.1 | Pseudomonas | GM24 | | 90.48 |
| GCF_000282155.1 | Pseudomonas | GM16 | | 90.46 |
| GCF_000282515.1 | Pseudomonas | GM80 | | 90.42 |
| GCF_000276585.1 | Pseudomonas fluorescens | N2011 | | 90.31 |
| LMG25716_finalassembly | Pseudomonas baetica | LMG25716 (T) | R1, t2 (TRBA 466, 31.03.2017) | 88.31 |
| GCF_001654515.1 | Pseudomonas koreensis | CRS05-R5 | | 87.73 |
| GCF_000514195.1 | Pseudomonas | URIL14-HWK12-I6 | | 87.60 |
| GCA_900105485.1 | Pseudomonas granadensis | LMG 27940 (T) | R1 (provisional classification by DSMZ) | 87.54 |
| GCF_000282275.2 | Pseudomonas | GM30 | | 87.53 |
| GCF_000292795.1 | Pseudomonas fluorescens | R124 | | 87.51 |
| GCF_000512275.1 | Pseudomonas moraviensis | R28-S | | 87.29 |
| GCF_001605965.1 | Pseudomonas koreensis | D26 | | 87.29 |
| GCF_000257605.1 | Pseudomonas | R62 | | 87.24 |
| GCF_000633255.1 | Pseudomonas | H1h | | 87.16 |
| GCF_000282255.1 | Pseudomonas | GM25 | | 86.96 |
| GCF_000012445.1 | Pseudomonas | Pf0-1 | | 86.76 |
| GCF_000316175.1 | Pseudomonas | UW4 | | 84.06 |
| GCA_900104125.1 | Pseudomonas reinekei | BS3776 | | 84.03 |
| GCA_900104905.1 | Pseudomonas jessenii | BS3660 | | 83.98 |
| GCA_900102045.1 | Pseudomonas moorei | BS3775 | | 83.96 |
| GCF_001945365.1 | Pseudomonas reinekei | MT1 | | 83.93 |
| GCA_900105115.1 | Pseudomonas mohnii | DSM 18327 (T) | R1 (TRBA 466, 31.03.2017) | 83.83 |
| GCF_900105285.1 | Pseudomonas umsongensis | BS3657 | | 83.65 |
| GCA_900105825.1 | Pseudomonas vancouverensis | BS3656 | | 83.64 |
| GCF_000237065.1 | Pseudomonas fluorescens | F113 | | 82.09 |
| GCF_000194805.1 | Pseudomonas brassicacearum subsp. brassicacearum | NFM421 | | 82.05 |
| GCF_000397205.1 | Pseudomonas protegens | CHA0 | | 81.14 |
| GCF_000336465.1 | Pseudomonas poae | RE*1-1-14 | | 81.09 |
| GCA_000012265.1 | Pseudomonas protegens | Pf-5 | | 81.02 |
| GCF_000009225.2 | Pseudomonas fluorescens | SBW25 | | 81.01 |
| GCF_000272675.1 | Pseudomonas tolaasii | DSM 19342 (T) | R1, p (TRBA 466, 31.03.2017) | 80.93 |
| GCF_001645105.1 | Pseudomonas marginalis | ICMP 3553 | | 80.92 |
| GCF_000276565.1 | Pseudomonas tolaasii | PMS117 | | 80.90 |
| GCF_001269845.1 | Pseudomonas fluorescens | DSM50090 (T) | R1+, n (TRBA 466, 31.03.2017) | 80.79 |
| GCF_000262325.2 | Pseudomonas fluorescens | A506 | | 80.78 |

Fig. 7

TTGCTCCCTGGATTCAGCGGCGGACGGGTGAGTAATGCCTAGGAATCTGCCTGGTAGTGGGGGACAACGTTTCGAAAGGAACGCTAATACCGCATACGTCCTACGGGAGA
AAGCAGGGGACCTTCGGGCCTTGCGCTATCAGATGAGCCTAGGTCGGATTAGCTAGTTGGTGAGGTAATGGCTCACCAAGGCGACGATCCGTAACTGTCTGAGAGGAT
GATCAGTCACACTGGAACTGAGACACGGTCCAGACTCCTACGGGAGGCAGCAGTGGGGAATATTGGACAAGCCTGATCCAGCAGCCGAAAGCCTAACTCTGTGTGAAG
AAGGTCTTCGGATTGTAAAGCACTTTAAGTTGGGAGGAAGGGCAGTAAATACTTTGCTGTTTTGACGTTACCGACAGAATAAGCACCGGCTAACTCTGTGCCAGC
AGCCGCGGTAATACAGAGGGTGCAAGCGTTAATCGGAATTACTGGGCGTAAAGCGCGCGTAGGTGGTTCGTTAAGTTGAAATGTGAAATCACCCGGGCTCAACCTGGGAAC
TGCATCCAAAACTGGCGAGCTAGAGTATGGTAGAGGGTGGTGGAATTTCCTGTGTAGCGGTGAAATGCGTAGATATAGGAAGGAACACCAGTGGCGAAGGCGACCACCT
GGACTGATACTGACACTGAGGTGCGAAAGCGTGGGGAGCAAACAGGATTAGATACCCTGGTAGTCCACGCCGTAAACGATGTCAACTAGCCGTTGGGAGCTTGAGCTC
TTAGTGGCGCAGCTAACGCATTAAGTTGACCGCCTGGGGAGTACGGCCGCAAGGTTAAAACTCAAATGAATTGACGGGGCCCGCACAAGCGGTGGAGCATGTGGTTTA
ATTCGAAGCAACGCGAAGAACCTTACCAGGCCTTGACATCGAGCGCAACCCTTGTCCTTAGTTACCAGCACGTAATGGTGGGCACTCTAAGGAGACTGCCGGTGACAAACCG
GCTCGTGTCGTGAGATGTTGGGTTAAGTCCCGTAAGTCCCCTTACGGCCCTTACGGCCTACAAATGGTCGGTACAACGGGTTGCCAAGCCGCGAGGTGGAGCTAATCCC
AGGAAGGTGGGGATGACGTCAAGTCATCATGCCCCTTACGGCCCTTACGGCTACACGCCCCTGCCAACTCGCCTGCGCTGAACTCGCCCTGCGCTGAACTCGCCCTGCTACAAATGGTCGGTACAACGGGTTGCCAAGCCGCGAGGTGGAGCTAATCCC
ATAAACCGATCGTAGTCCGGATCGCAGTCTGCAACTCGACTGCGTGAAGTCGGAATCGCTAGTAATCGTGAATCAGAATCGTCACGGTGAATACGTTCCCGGGCCTTGT
ACACACCGCCCGTCACACCATGGGAGTGGGTTGCACCAGAAGTAGCTAGTCTAACCTTCGGGAGGACGGT

SPECIES OF GENUS *PSEUDOMONAS*

CROSS-REFERENCE TO RELATED APPLICATION

This application is a national stage entry of and claims priority to PCT/EP2018/075071, filed Sep. 17, 2018, which is hereby incorporated by reference in its entirety.

FIELD OF INVENTION

The invention relates to a new species of genus *Pseudomonas*, termed *Candidatus Pseudomonas metallosolvens*, the use thereof for the recovery of precious metals from solid materials, a composition containing the new species and an isolated nucleic acid.

BACKGROUND OF THE INVENTION

The recovery of copper from ores by means of cyanide and suitable extractants like guanidine (LIX 7950) or amines (LIX 7820) is known for decades (for example U.S. Pat. No. 3,403,020, 1968). The free cyanide remains in the aqueous phase due to the preferential extraction of $Cu(CN)_3^{2-}$ over $Cu(CN)_4^{3-}$ and $CN^-$ by the extractants. High cyanide levels tend to depress extraction of copper and silver cyanides, but exhibit insignificant effect on extraction of gold, zinc, nickel and iron cyanides. An overview for this technology is provided for example by XIE ET AL in J. Hazardous Materials, Vol. 169, p 333-338 (2009).

While in the past the process for recovering copper and precious metals, in particular gold by using potassium or sodium cyanide has led to huge waste dumps contaminated with poisonous materials, todays processes run in closed cycles and do not have the environmental impact as in the past. Nevertheless, working with cyanides even in closed systems is still dangerous, in particular since a plant typically contains hundred thousands of gallons extractants enriched with cyanide.

For this reason it is not surprising that today methods for biological extraction of ores and waste materials, so-called "bioleaching processes" are of high commercial interest. Usually autotrophic bacteria are used for these purposes which are capable of producing sulfuric acid in which copper forms a soluble sulfate. Nowadays, about 24% of world-wide copper production uses bioleaching processes operating at low pH values of less than 3 and using carbon dioxide as the sole carbon source for the microorganisms. Beside the fact that these processes run rather slowly, they typically do not work for precious metals like gold, silver or platinum, since these metals are insoluble in sulfuric acid.

In this context reference is made to European patents EP 0432935 B1 and EP 0695809 A1 (GEOBIOTICS) disclosing processes to recover and reconcentrate gold from its ores. The processes involve a bioleaching step preferably using algae or blue-green cyanobacteriae as suitable microorganisms for producing and releasing hydrocyanic acid to form gold complexes. Among various other microorganisms *Bacillus megaterium* and some *Pseudomonas* sp. are mentioned. The technical teaching of this piece of prior art, however, is directed to recover gold from ores, i.e. a natural, primary resource that only contains traces of precious metals of <10 ppm. The document does not provide any guidance with regard to the recovery of precious metals from manmade mineralic materials such as industrial residues and waste materials containing precious metals in significantly higher amounts than ores.

Another well-known microorganism for recovering gold for example from electronic scrap is *Chromobacterium violaceum*. Unfortunately, the efficacy of this bacterium in the leaching process is found to be rather poor [see CAMPBELL ET AL, J. Industrial Microbiology & Biotechnology, 26, p 134-139 (2001) or FARAMARZI ET AL, J. Biotechnology. 113, 321-326 (2004)]. Furthermore, *Chromobacterium violaceum* is a pathogenic microorganism that can cause severe infections in humans, therefore being classified as risk group 2. This fact compromises the use of this organism in an economically viable, industrial set-up.

A particular drawback of using industrial residues and waste materials, however, is their generally high amount of toxic metals, in particular lead, chromium, cadmium, arsenic or silver since most microorganisms capable for biomining or bioleaching are rather sensitive to them, in particular when present in high dosages.

Therefore, it has been the object of the present invention to provide a group of microorganisms for recovering precious metals like for example gold, silver, platinum and/or palladium from so-called secondary resources, which means industrial residuals or waste materials, often contaminated with polychlorinated biphenyl (PCB) and other organic material, comprising increased amounts of the target metals, typically in the range of up to 0.2% or more.

Another object of the present invention is it to provide a group of microorganisms tolerating poisonous metals such as lead, chromium, cadmium and silver also in high dosages as they are typical for industrial residues and waste materials.

Finally, for safety reasons, it has been the object of the present invention to provide a group of microorganisms belonging to risk group 1, since in the future no technical process will pass approval from governmental health and risk authorities involving microorganisms belonging to risk class 2 or even higher.

These and other objects of the present invention will become apparent as a detailed description of the representative embodiments is disclosed infra.

DESCRIPTION OF THE INVENTION

This object is solved by claim 1 of the present invention, which is directed to a species of genus *Pseudomonas* termed *Candidatus Pseudomonas metallosolvens* (in the following: *Pseudomonas* BR11571) having Accession Deposit Number DSM 32538.

Surprisingly the inventors have found that the new species *Pseudomonas* BR11571 has a lot of advantageous characteristics, for example (a) being able to extract precious metals from secondary resources such as industrial residues and waste materials;

(b) producing biogenic substances facilitating the solubilization of precious metals; and (c) belonging to risk group 1.

Biogenic substances in general are substances produced by life processes. In the present invention a biogenic substance is any substance produced by the new species *Pseudomonas* BR11571. In a preferred embodiment according to the invention the biogenic substances comprise hydrocyanic acid.

In one embodiment according to the invention the biogenic substances are produced in the presence of amino acids. In a most preferred embodiment according to the invention the biogenic substances are produced in the presence of glycine. In a preferred embodiment according to the invention biogenic substances comprising hydrocyanic acid are produced in the presence of amino acids. In a most preferred embodiment according to the invention biogenic substances comprising hydrocyanic acid are produced in the presence of glycine.

As used herein, the singular form "a," "an," and "the" include plural references unless the context clearly dictates otherwise. For example, the term "a compound" or "at least one compound" may include a plurality of compounds, including mixtures thereof. Thus, for example, reference to "solid material," "the solid material," or "a solid material" also includes a plurality of solid materials; use of the term "a nucleic acid" optionally includes, as a practical matter, many copies of that nucleic acid molecule.

As used herein, the term "about" indicates that a value includes the inherent variation of error for the method being employed to determine a value, or the variation that exists among As used herein the terms "species", "strain" (with regard to *Pseudomonas* BR11571) and "*Pseudomonas* BR11571" can be used synonymously since the terms all relate to *Candidatus Pseudomonas metallosolvens* (having Accession Deposit Number DSM 32538.

FIGURES

FIG. 2: shows sequence similarity (expressed as percentage) of partial gene sequences (675 nt) of housekeeping gene gyrB (program arb, filter cFN55420 675 nt, Ludwig et al., 2004).

FIG. 6: shows the average nucleotide identity based on BLAST algorithm (ANIb). ANIb analysis (percentage identity) was performed using program PYANI (Pritchard et al. (2016)).

METAL RECOVERY

While *Pseudomonas* BR11571 according to the invention is basically also useful for leaching ores, the focus lies on solid materials containing precious metals, particularly gold and silver, but also platinum, palladium, rhodium, iridium and their mixtures. The microorganisms are also suitable for leaching copper, which is not typically counted among the term precious metal. Therefore the term "precious metal" includes gold, silver, platinum, palladium, rhodium, iridium, copper and their mixtures.

The term "secondary resources" means industrial residuals or waste materials, often contaminated with PCB and other organic material. Preferred suitable secondary resources are according to the present invention fly ashes, waste incineration ashes, metal scoriae, electronic scraps and the like.

Biocyanide:

The ability of *Pseudomonas* BR11571 to extract precious metals from solid resources is mainly attributed to the production of hydrocyanic acid in the presence of amino acids, in particular glycine. Besides, however, other biogenic substances are produced which facilitate the solubilization of precious metals. This leads to the surprising effect associated with the present invention that less (bio-) cyanide is required than in an abiotic, chemical process known from the state of the art.

*Pseudomonas* Br11571:

According to the invention, *Pseudomonas* BR11571 is provided as a new organism. This organism can be used to extract precious metals from solid materials. Surprisingly, this organism is able to extract precious metals also from materials that contain elevated levels of toxic metals such as lead, chromium, cadmium and silver. This allows the conclusion that the organism is not only able to extract precious metals from solid materials but has also a high tolerance against external conditions.

Figure 1:
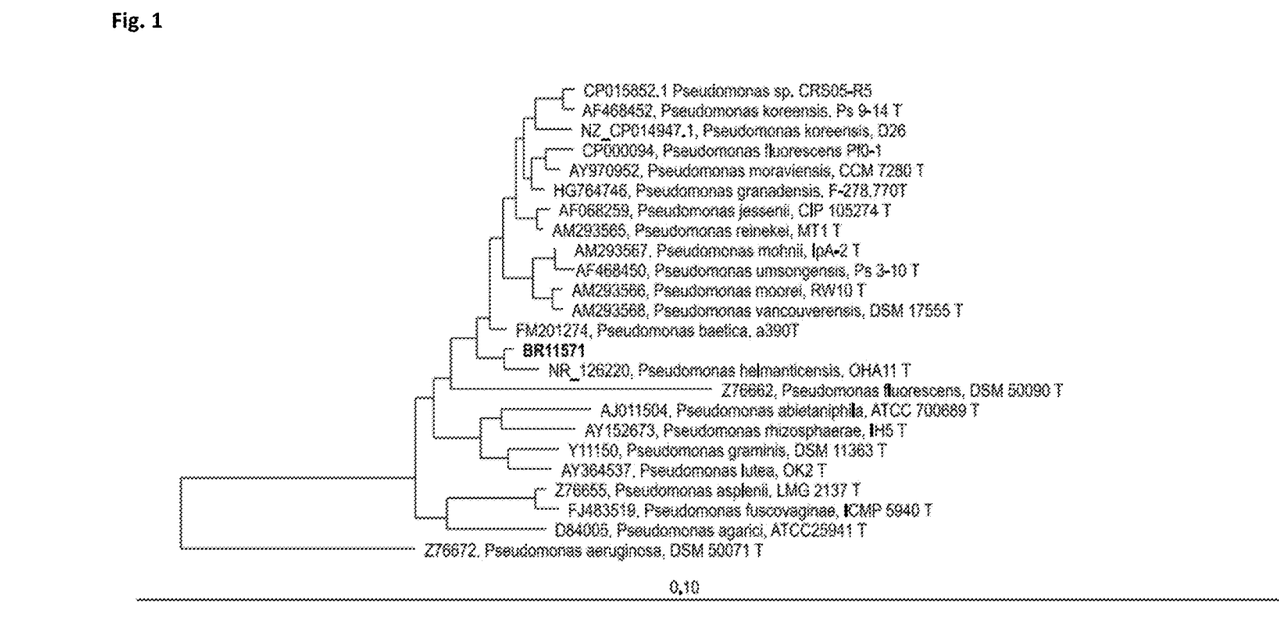
FIG. 1: is a distance matrix which was calculated by the Jukes-Cantor correction method using filter cBR11571 (*E. coli* position 100 to 1465 using arb-program, Ludwig et al., 2004) based on partial 16S rRNA gene sequences. Tree Dendrogram was generated by neighbor joining method.

The affiliation of the new species to the genus *Pseudomonas* was revealed by performing 16S rRNA gene analysis (FIG. 1).

It has been found that *Pseudomonas* BR11571 represents a novel species of the genus *Pseudomonas*. Classification of *Pseudomonas* BR11571 to a novel species of genus *Pseudomonas* was supported by phenotypic (API, BIOLOG) and genotypic data (further phylogenetic analysis of partial sequences of the housekeeping genes rpoB, rpoD and gyrB and calculation of average nucleotide identity (ANI) based on BLAST algorithm using scaffold genomes. Strains with less than 94% ANI with regard to scaffold genome are regarded as new species of a genus (according to e.g. Richter and Rosselló-Móra, 2009). BLAST analysis of scaffold genome DNA sequences showed that the next neighbor to *Candidatus Pseudomonas metallosolvens* BR11571 shared a percentage of ANI of ca. 91%.

Furthermore, the physiology of *Pseudomonas* BR11571 was found to be distinct from *Pseudomonas* species known so far as indicated by the API (Biomerieux API 20 NE) and BIOLOG (BIOLOG PM1, PM2A) assays.

The closest relatives of *Pseudomonas* BR11571 as revealed by partial sequence analysis of housekeeping genes rpoD, rpoB and gyrB and ANI analysis using scaffold genomes are *P. helmanticensis* OHA11 (Type strain), *P. granadensis* F-278,770 (Type strain) and *P. koreensis* DSM16610 (Type strain), all belonging to risk group 1 (FIGS. 2 to 6). Furthermore, 16S rRNA and partial sequence analysis as described above showed that *Pseudomonas* BR11571 belongs to *Pseudomonas koreensis* subgroup within the *Pseudomonas fluorescens* complex (Garrido-Sanz et al., 2016). Known type strains affiliated with *Pseudomonas koreensis* subgroup (Mulet et al., 2010) have been classified into risk group 1. Therefore, the new species *Candidatus Pseudomonas* BR11571 can be classified as risk group 1.

Deposit of Biological Material:

The isolated and identified species *Pseudomonas* BR11571 was deposited on Jun. 13, 2017, under the provisions of the Budapest Treaty in the Leibniz Institute DSMZ—German Collection of Microorganisms and Cell Cultures. It has been assigned to the Accession number DSM 32538.

In a preferred embodiment according to the invention, the new species belongs to risk group 1. The term "risk group" is a classification system which is used in many countries for the classification of microorganisms. The affiliation to a risk group depends for example on the following factors Pathogenicity of the organism Mode of transmission and host range Availability of effective preventive measures (e.g. vaccines)

Availability of effective treatment (e.g. antibiotics)

All microorganisms which belong to risk group 1 are not associated with disease in healthy adult humans (see NIH Guidelines in Recombinant DNA, April 2002).

In an embodiment according to the invention the ribosomal DNA of *Pseudomonas* BR11571 has SEQ ID No. 1.

As mentioned above, *Pseudomonas* BR11571 according to the invention is capable of producing biogenic substances. These biogenic substances produced by the *Pseudomonas* BR11571 facilitate the solubilization of precious metals from solid materials in the presence of amino acids. In a preferred embodiment according to the invention the biogenic substance produced by *Pseudomonas* BR11571 is hydrocyanic acid. In a further preferred embodiment the amino acid is glycine. In a most preferred embodiment according to the invention hydrocyanic acid is produced by *Pseudomonas* BR11571 which facilitates the solubilization of precious metals from solid materials in the presence of glycine.

Use:

In one embodiment according to the invention *Pseudomonas* BR11571 is used for extracting precious metals from solid materials. In a preferred embodiment according to the invention the solid material is a secondary resource. In a further preferred embodiment according to the invention the solid material is selected from the group consisting of fly ashes, waste incineration ashes, metal scoriae and electronic scraps.

Preferably the precious metals are selected from the group consisting of gold, silver, platinum, palladium, rhodium, iridium, copper and their mixtures.

Composition:

A further embodiment according to the invention relates to a composition comprising:

(a) *Pseudomonas* BR11571 in amounts effective to facilitate the solubilization of precious metals by releasing biogenic substances;

(b) at least one solid material; and (c) at least one amino acid.

In a preferred embodiment the at least one amino acid is glycine. In a further preferred embodiment according to the invention the biogenic substance comprises hydrocyanic acid.

Method:

One embodiment according to the invention relates to a method for extracting precious metals from solid material with *Pseudomonas* BR11571. In a preferred embodiment the solid material used in the method is a secondary resource. In a more preferred embodiment the solid material is selected from the group consisting of fly ashes, waste incineration ashes, metal scoriae and electronic scraps.

In a further preferred embodiment according to the method of the present invention the precious metals are selected from the group consisting of gold, silver, platinum, palladium, rhodium, iridium, copper and their mixtures.

In an embodiment according to the method of the present invention *Pseudomonas* BR11571 produces biogenic substances in the presence of amino acids which facilitate the solubilization of precious metals from solid materials. In a preferred embodiment according to the method of the present invention the biogenic substance released by *Pseudomonas* BR11571 comprises hydrocyanic acid. In a further preferred embodiment according to the method of the present invention the amino acid is glycine.

Isolated Nucleic Acid:

A further embodiment according to the invention relates to an isolated nucleic acid having at least 91% identity to SEQ ID No. 2.

In a preferred embodiment according to the invention the isolated nucleic acid having at least 92%, at least 93%, at least 94%, at least 95%, at least 96%, at least 97%, at least 98%, at least 99% identity to SEQ ID No. 2. In another preferred embodiment according to the invention the isolated nucleic acid having 100% identity to SEQ ID No. 2. In other words, the isolated nucleic acid is SEQ ID No. 2.

In a most preferred embodiment according to the invention the isolated nucleic acid having at least 94% identity to SEQ ID No. 2.

As used herein, the term "identity" when used in relation to nucleic acids, describes the degree of similarity between two or more nucleotide sequences. The percentage of "sequence identity" between two sequences can be determined by comparing two optimally aligned sequences over a comparison window, such that the portion of the sequence in the comparison window may comprise additions or deletions (gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. An alignment of two or more sequences may be performed using any suitable computer program. For example, a widely used and accepted computer program for performing sequence alignments is CLUSTALW vl 0.6 (Thompson, et al. (1994) Nucl. Acids Res., 22: 4673-4680).

SEQ ID No. 2 represents an artificial sequence. This artificial sequence is the scaffold genome sequence of *Pseudomonas* BR11571. As used herein the term "scaffold" is a type of sequencing created by chaining contigs together using additional information about the relative position and orientation of the contigs in the genome. "Contigs" are continuous stretches of sequence containing only A, C, G, or T bases without gaps. Contigs in a scaffold are separated by gaps, which are designated by a variable number of 'N' letters.

EXAMPLES

Example 1: Isolation and Identification of *Pseudomonas* BR11571

*Pseudomonas* BR11571 was isolated according to the following procedure: plating a soil suspension in 0.85%

NaCl on 0.5×HD nutrient agar plates supplemented with 4 mM KCN and 100 µg/ml nystatin. Appearing microbial colonies were transferred and purified by a "clean streak" on fresh agar plates and subsequently analyzed for hydrocyanic acid production as well as for leaching efficiency of precious metals from secondary resource. Microorganisms that met the performance criteria were phylogenetically characterized by 16S rDNA analysis. The affiliation of strain BR11571 to the genus *Pseudomonas* was shown by performing 16S rRNA gene analysis of partial 16S rRNA gene sequences (FIG. 1) using program arb (Ludwig et al., 2004).

The strain was cultivated on LB medium (such as Bacto Tryptone #211705 (BD) 1% (w/v), Bacto Yeast Extract #212750 (BD) 0.5% (w/v), NaCl #141659.1221 (Applichem) 0.5% (w/v) and also mineral media such as M9 [according to: Harwood, C. R., and S. M. Cutting. 1990. Chemically defined growth media and supplements, p. 548. In C. R. Harwood and S. M. Cutting (ed.), Molecular biological methods for *Bacillus*. Wiley, Chichester, United Kingdom.] both supplemented with casamino acids (0.25%/w/v)) and glycine (0.5% (w/v)). Suitable incubation temperatures are preferably in the range of 28–30° C.

Figure 7:
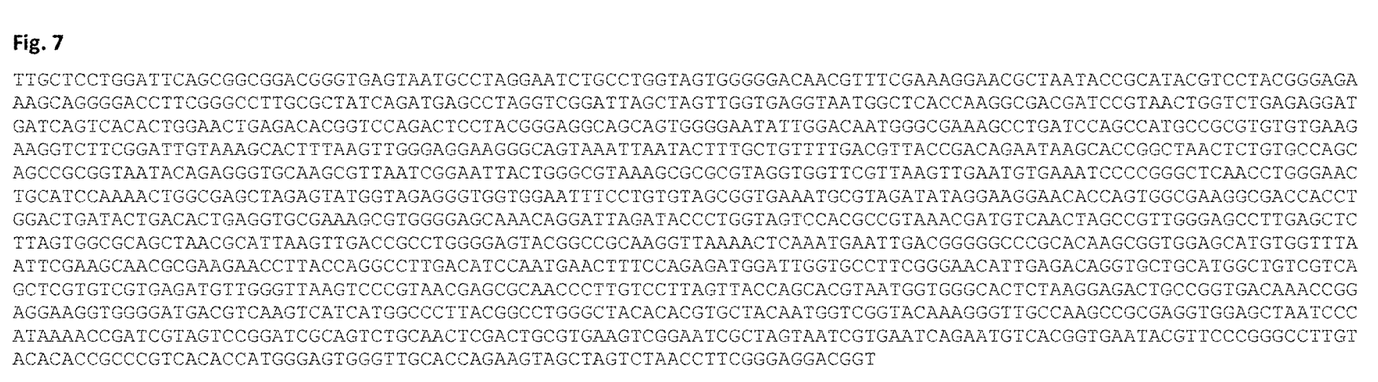
FIG. 7: shows the 16S rDNA sequence of *Pseudomonas* BR11571, which is SEQ ID No. 1.

The 16S rDNA sequence of *Pseudomonas* BR11571 is shown in FIG. 7 and SEQ ID No. 1. The isolated and identified strain has been submitted on Jun. 13, 2017 to the Leibniz Institute DSMZ—German Collection of Microorganisms and Cell Cultures. It has the accession number DSM 32538.

Example 2: Phylogenetic Analysis of *Pseudomonas* BR11571 and Definition of a New Group of Genus *Pseudomonas*

Figure 3:
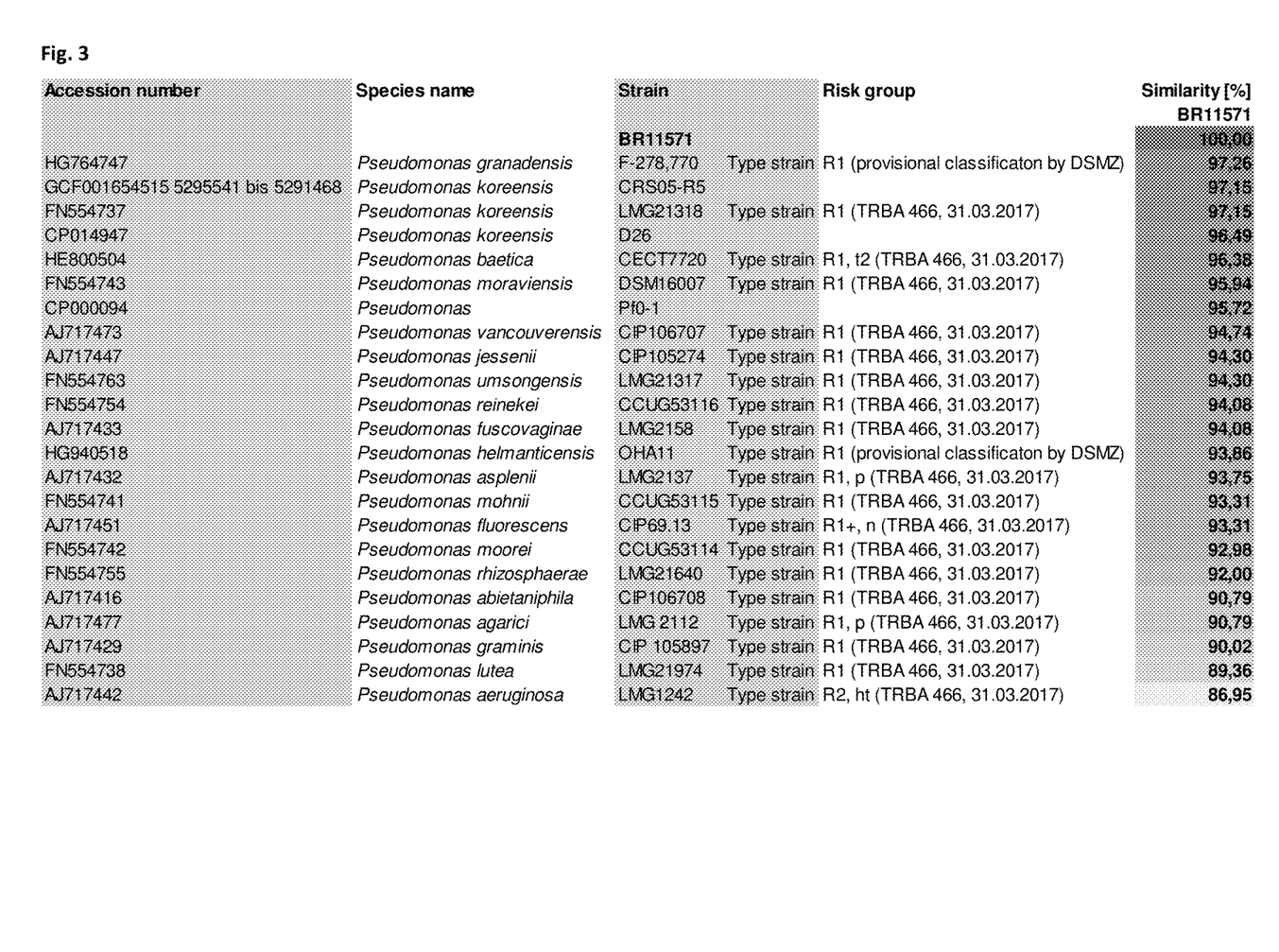
FIG. 3: shows sequence similarity (expressed as percentage) of partial gene sequences (912 nt) of housekeeping gene rpoB (program arb, filter SAI_AJ7174 912 nt, Ludwig et al, 2004).
Figure 4:
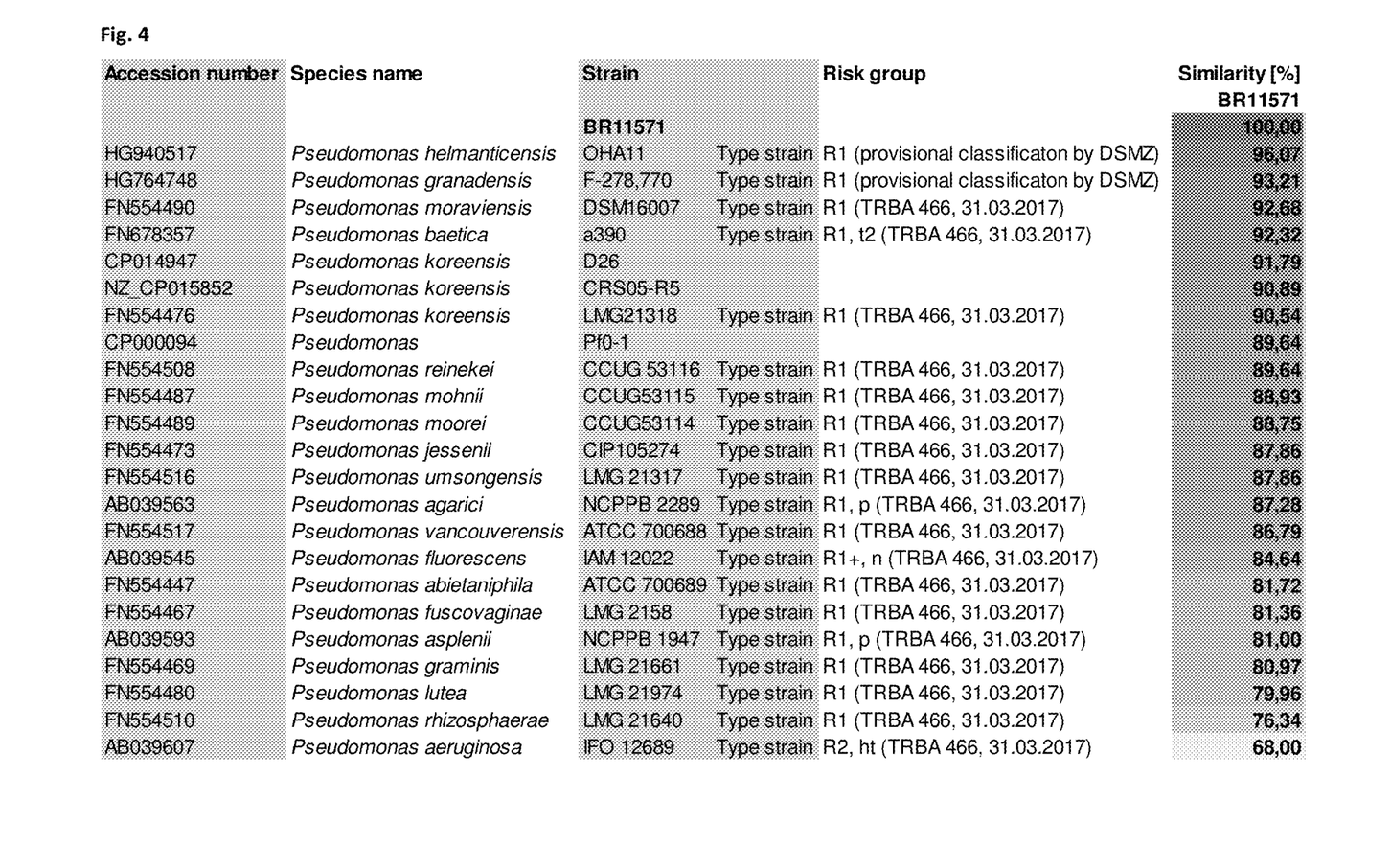
FIG. 4: shows sequence similarity (expressed as percentage) of partial gene sequences (560 nt) of housekeeping gene rpoD (program arb, filter cFM25190 560 nt Ludwig et al, 2004).
Figure 5:
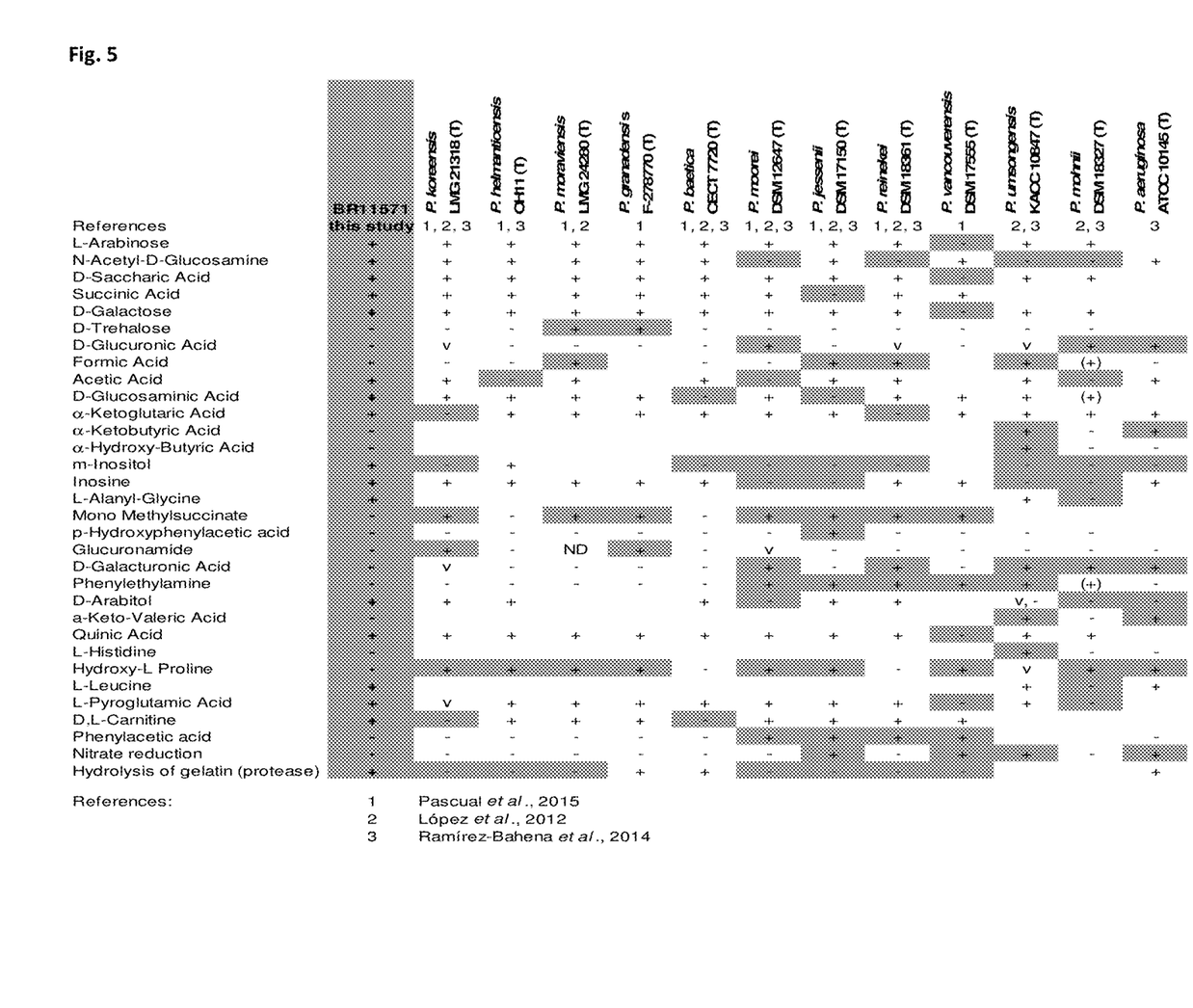
FIG. 5: shows analyzation of physiological traits of BR11571 with the standardized system for identification of non-fastidious, non-enteric Gram-negative rods that is API 20 NE (BIOMERIEUX) and carbon utilization tests based on BIOLOG PM1 and PM2A plates (BIOLOG) according to the manufacturer's instructions. Results were compared with selected results of relevant strains.

16S rRNA analysis of partial 16S rRNA genes revealed that BR11571 belongs to genus *Pseudomonas* (FIG. 1). Partial gene sequences of the housekeeping genes gyrB, rpoB and rpoD were analyzed to further investigate phylogenetic relationships of BR11571 (FIGS. 2-4). These four core "housekeeping" genes are usually used for analyzing *Pseudomonas* phylogeny (e.g. Mulet et al., 2010). A threshold of about 97% sequence similarity using these housekeeping genes has been suggested for species differentiation within the genus *Pseudomonas* (Mulet et al., 2010; Gomila et al., 2015). As is shown in FIG. 2, FIG. 3 and FIG. 4 maximal similarity values to closest related type strains are around 97%. These data suggest that *Pseudomonas* BR11571 is supposed to be a new species. To analyze physiological traits of BR11571 the standardized system for identification of non-fastidious, non-enteric Gram-negative rods that is API 20 NE (BIOMERIEUX) and carbon utilization tests based on BIOLOG PM1 and PM2A plates (BIOLOG) were used according to the manufacturer's instructions. Results were compared with selected results from literature of physiological tests of relevant strains. Relevant strains were chosen based on above phylogenetic sequence analysis results (FIG. 5). Analysis revealed that the physiology of *Pseudomonas* BR11571 is distinct from so far known *Pseudomonas* species as indicated by the API and BIOLOG assays (FIG. 5). These data further underline that *Pseudomonas* BR11571 can be classified as a novel species of the genus *Pseudomonas* termed *Candidatus Pseudomonas metallosolvens*.

DNA-DNA hybridization was substituted applying ANI analysis (e.g. Richter and Rosselló-Móra, 2009). The species level boundary proposed was set at about 94% ANI (e.g. Richter and Rosselló-Móra, 2009). As shown in FIG. 6 ANIb similarity values are below 91%. These results further underline that *Pseudomonas* BR11571 represents a novel species of the genus *Pseudomonas*. *Pseudomonas* strains sharing at least 94% ANI to scaffold genome of *Pseudomonas* BR11571 are regarded to be part of the new group of *Pseudomonas* (Goris et al., 2007)

Example 3: Recovery of Precious Metals Using *Pseudomonas* BR11571

Electronic scrap, i.e. printed card boards (PCB) was subjected to bioleaching using (a) *Pseudomonas* BR11571 (according to the invention)

(b) *Chromobacterium violaceum*, DSMZ 30191 (for comparison)

as heterotrophic microorganisms capable of producing and releasing hydrocyanic acid. The waste material with regard to metals mainly consisted of copper (6% b.w.), iron (6% b.w.), aluminum (4% b.w.) and zinc (2% b.w.). It also contained significant amounts of precious metal, particularly silver, gold and palladium.

Sample material was finely grinded in an impact mill. The resulting fine fraction (<1 mm) was used for leaching experiments. 1 g of this material was added to a leaching vessel having a volume of 0.3 l. The vessel was filled with 0.1 l of an aqueous solution comprising the microorganisms or (b), respectively in an amount of about 1 g/l wet weight, also containing minerals and carbohydrates in amounts suitable to serve as nutrients for the microorganisms. An amount of 0.5 g glycine was added to sustain hydrocyanic acid production. The mixture was heated to about 30° C. and agitated over a period of 120h at about 180 rpm. Subsequently, the slurry was collected by centrifugation and the liquid phase was analyzed for the amount of released precious metals and copper by ICP-MS analysis. Experiments were carried out in triplicate. The results are shown in Table 1.

TABLE 1

Recovery of precious metals from PCB

| | | Example 1 | |
|---|---|---|---|
| | Content [ppm] | Efficacy *C. violaceum* [%] | Efficacy BR11571 [%] |
| Ag | 713 | 2.8 ± 0.04 | 12.6 ± 3.4 |
| Au | 80 | 15.4 ± 0.8 | 20.3 ± 4.2 |

*Pseudomonas* BR11571 shows a 5-fold increased leaching efficiency of silver and 30% better leaching of gold than *Chromobacterium violaceum*. Furthermore, *Pseudomonas* BR11571 belongs to risk group 1, while *Chromobacterium violaceum* belongs to risk group 2, compromising the use of the latter microorganisms in an economically viable, industrial set-up.

SEQUENCE LISTING (2 sequences)

SEQ ID NO: 1 - DNA, 1378 bp, Candidatus Pseudomonas metallosolvens
ttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggttcgttaagttgaatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggt

SEQ ID NO: 2 - DNA, 6381510 bp, Candidatus Pseudomonas metallosolvens (residues 1-1,595,378 of 6,381,510)
  misc_feature (4887461)..(4887560): n is a, c, g, or t
  misc_feature (5925964)..(5926063): n is a, c, g, or t
  misc_feature (6184509)..(6184608): n is a, c, g, or t
  misc_feature (6372068)..(6372234): n is a, c, g, or t
agcacgccgggtttgtgcaggagttcttcgagcttcaggtcggggcgggcgctgatcagttcaatgtcgaagcagaacggctggttgatggcttcgcggccaacaaaactcagcacttgcaggtcagtggaaacggcttcgagcgaaaaggtaatgtgggtagcgtttgcgtccagcatgcctgactccttccgtggaaaagctttgccgatggtgccggaataccaaagtgctatcaagggtttttaaacgcacttgccggtcgggattaaactcaatttcacggctgtgtaacggagtgcccgcgaggatgaattcaccatggattcgctgattaatgccgctggccgggcgctggctggcggtgatccgctggcggcattgaagcttgtggcattgcgcgaggatccaccggcactggcgttgcgcggcatcgccatggctcagctcggcgacttttctcgagctaaagccttgttgcagcgggcggtgcgagggtttggcgcgaatgagccgctgtccaaggcgcgctgcgtggtggcgcaggccgaagtggctctggcagcgcgggatctgggctggccggtcaaggcgctggagacggcgcgacagtttttacacgcacacggcgatgctttaaacgcagcgcacgcgggttatttgcagattcgccgatggctgctgatcggtgaactggacgaggctgaagcgctgctcggccaaatgaccccgacagtgttgccgccggttctgcgcgccgttcatgagctgatgacggccggcatcgccctacgacgggtgcaggcgcacaaagcacagatcaccctgacgcgggcgcaacaagccgctgattcggcaggcattccttcactgagcgcggaaatcgaacacgcctggcaaatcctcaaggctcctgcagcctgcttgacccatgcgggtcagtcgcaatgggtgacgctggcacaggttgaagacctgtttgcatcgccaacactgatcattgatgcctgtcgctacagcgtacgtggtgcaggcatgcgcgtgtccctggcatccaggccgctgctgttcaatctcgcccgcaccctcgctgaggcctggcccgccgatgtctgccgggaagtgctgattgccaaggcctttcgtttgaagctcagcgatgagtcccatcgcgtgcgcctgcgggtcgaaatcggccggttgcgggcggcgttgcaaccgctggcgaagatcaccgcgacccgtcggggttttgcgctggaggccgatgatgtggcgctgttgaccctgcccgcagaggacaaatacgccgcgctgctggccctgctcggcgacggcgaagcctggtcgagttcggccctggcgctggcgttggggagcagtcaacgccaggtgcagcgggcactggagacactggcatgcgaagagaaagtgcagtcgtttggattgggccgcgcgcggcgctggatgacgccgccggtaccgggtttcgcgacgatcttgttactcccggtgtcgctgggcagtggctagtctggcctctcacacctttgaggaagtcaccatgaaacagacaaacgcagaagtgcttcgtgaatatgggccgttcgacggtgtcggcaatgtccacggcgtcacgtttgacggccagcaagtgtggttcgccagcgacggtcaactcaatgcgctcgatccggcgagtggcgaaaccgtacgcacgatcaaggtcggtgccgatgccggtaccgcgttcgacggcaaacacctgttccagatcgccgacagtcgtatccagaaaatcgacccggccaccgggcgggtgctcaacaccattgcggcaccgggcggcggcaatgattcgggcatggcgtgggccgagggttcgctgtgggtcgggcagtatcgcgagcgcaagatctatcagatcgacccggacaccggcgagattctgcgcacgctgcaatccaaccgttttgtcaccggcgtgacctgggtggacggcgcgctgtggcacggcacgtgggagggtgatgaaagcgagttgcggcgcattgacccgcagaatggcgaagtgctggaaagcctgaagatgcccgacgggattggcgtttccggattggaggccgatgctggcgaacggttttattgcggtggcggcggcagcgggcgagtgcgagcggtgcgccggcccaagtgattgatggcgccagcactggccacatcgccagcagggctggctcctacatgttgaatgcactcccctgtggtagctggcttgccagcgatggggtcgtgccagaccgccacatttttgtccggtgaacgccgaacccatgtgggagccagccctgctggcgatagggcccgctgcatcacctcgaaatcaaggcgccccaaacaccatcgtccagtaaaccccttcatcactgcgcgactcgctggcgaacccggcgccgacctgggtgaacatcgggttcatcaggttggcgcaatgcccggggctggccagccagccggccatggctctgcccggcgaactctgcccggcggcgatgttctcgcccacctgccgacctcgataacccgccgcccgggcgcgatcggtgggcatctcgccatccgggtcgcgatgggcgaagtagttgccataagccatggctttgctgtgtccctgcgccgcagccccagtgctgcgttccagctcaacgggcgggccgcagcaaaacgctggcgtccgcacattcgagggcgagcgcgagcggcgttgacttccgccagcagcgctttgccgacgctgcggttgtcaccgacgcggctgtcgagcaccggacgggccaacaccacttgccactcactgcgtgagcggctgatgccgatgtcggcgtaggtcgcatcgagcaacgcaccgcaataatcactttgcaatcggtcgaatgcctcttcggcatcttgcgcgccgacgatgcgaatgctgcgcaccgcgaccgctgaatatcccgaggccttcagcgcctcgcgcattccgccgccgtagcgatagccgatcggcaatgccagattcgatttcaaggccagcggtgcgaggcgttgcgcggggcgtcgatcgcagcgttgcgggtgggcgcgatagtcattgatggcggccaccagttgtcgctctgccccagcgtgggcggcgttggccaataaaaatgcaaggatcagcaagcacagcgaaacgaagcgagacgaacgaacggcgtggcgcatgggacggacagctctaaaagggggacagcgctaaggtgaggtcagccgcagggcgcggcgcgaataggactggggtttgcggacttggttcaggggtaatagagaggcttttgtggcggggcgacgaaaagtgcgatctggcagaattatagttgcgccgaaagacgctatcgcgagcaggctcactcctacattggaatgcatttcaaatgtaggagtgagcctgctcgcgatggggccattgaaagcgtcacattactcaaatgcagaacagctcagcggttcagcacatcccccatccactgccaatactgtggtcggtctgaaatcgaattatgccccgactccggcaccaccttgagcaccgccacgtccttggggaagttctccagcaagcgctgcgtactgtcccgcgcgatcacctcgtcatcactggccgccagcaataacgtcggtacgcggatatgcgcggcatacttgcccgactcgaaacgatccttgagcaaccactgcaccggcacccacggatattgcttcgcggcgatttcttcgaggctgttgtaaggcgtcaccagaatcagctgttgcaccggccgctgactggccagacgcaccgccacaccggaaccaaggctacgtccgaccacggcaatctgcggatgactgacagccacttgatcgaacagcgccaacgcatcctcggcaatcgcctcttcggacggcgaaccgccgctgccgccaaaaccccggtagtgcagcaggtacaacgcgtaatcgggaaaggcctcggcaaactccggcaggttgcgcgacacgtcctcggcattgccaccgaaatagatcagcgcccgtggccctgtgcgctcgcgggtgctcacccacacctcggtatccgccatcgacagtttcaaccgcgagtccgccgatgccacggcagcgggttgtggaaagtagatcagcgaacgctggaaaaagaacagcgccgtgcacagcagcaggtacacggccacgatcaaaacgacgagtgacatcagggttcgggacattcggctacttttaacggggtgagaaggttcgctgtcgcagtgtagtccagcgattcgctcgggcagcctgcgcacacaacatgcaacagatccacgcagcaggggaaccagcatgagccacactgagggttactcccgtcgccgattgctctcgctggctgccggggtttcggcggtcttcaccttgaatcgggcgttggccactgccacgccacccgcgattagccgaggccacgccatgcagacccgcgccattccctccagctccgaatcattgcccatggtggggctgggcacttatcgcggtttcgacgtcgcgccgggcgacccgctctatcggcagttgccgacggtgctcgatgagctgttcaccaagggtggcacggtgatcgacagttcgcccatgtatggccgcgccgaacagaccaccggcgaattgctgtcgatccacgaaccacgttcgccggcatttctcgccaccaaggtgtggacccgcggccgcgaggcgggcatcgcgcagatggagcagtcgttcagcctgctgcgcaccgagcgcatcgacctgatgcagatccacaacctgctcgattggcaaattcacctgccaaccctgcgcgaatggaaagagcaggggcgcatccgctacatcggcatcacccattacaccgcctcggcctatgacgaagtcgaagcagtgctcaaggccgagcaactggattttctgcaaatcaactacgccctcgatgaccgtggcgtggagaagcgcatcctgcccttgtgccgcgagcgcggcgtggcagtaatctgcaaccgaccttttggcggcggcgatctgctcgcccggctcaaaggcaaaccgctgccggcgtgggtgtcggatgtacaggtcaacagttggccgcaactggcgctgaagtttctgctggcgcatccggcggtgacgtgtgtgattccggggacgagcaatccgcgttacatggccgataacgtcaaggccgggttcgggccgatgctcaccgatgcgcagcggcatcagttgattgcgttggtgggctgatcgccgggaatgcccaggttgtcgatgtgtttgaagcgttcgaccagaaagtcgatcaggctgcgcacccgcgcggacagatgcagttgttgtggatacaccgcgtaaacgtcggcgcgggtcggcgtctgatcttccagcaccagacgcaagcgtccgctgcgcacgtaacgggcgatgtcccactcggcgcgaagcagaatgccgaacccttccagcgcccagttcagcgccacttcgccgtcattgcagcccagcgcgccgcgtaccttgatgttctgagtgcgcccgccgtttgcgaagctccacaccccgtaaggcgtttcgttctggcgcaggaagatgcaattgtgctgctgcaggtcggcgagcttttgcggcacgccgtgcttttccagatacagcggcgaggcgcagagcaagcgtcggtttgaggcaatcttgcgggcatggaaggccgcgtcgggcaaggtgccgaaacggatgcccagatcgaatccgtgggtcgccaggtccagcgggtggtcgctgatttccagctggatctccacctccgggtattgcgcgaaaaacgccgccagtgccgggccgatataacgtcgaccaaaacccagtgacgcgttaacccgaatcagccctttcggtgtcgcccggctggcaccgatcagctgctcgacctcgtcgatctgcgtgagaatccgcgcggcgtgggagaagtacaactcgccctcagcggtcaggctcatcgagcgcgtggtgcgattgaccagacgcacacccagtcgtgcctccagcgccgtcaggcgtttgctcacggcgggcggcgtcacgcccagttcgcgggcggtggcggcgaggctgcctttgttggccagcaagtggaaaaacgacaaatcgagggtctggctcattcgtaactcaaagtcatggatgtagtgatttgcggtaactcacagctttcaggtcactacatatactccgatcacaccccgccggacagacttgtacggcaggcaaaacaaaaacgtgaaagagtggagttgaccatgagcgcatacaacattgcagcggtgcccggcgacggtattggcgtggaagtgatcgcagccggcgtcgaagtgctgcaggccctgtcgaagaaatccggctttgaactgacgttcaaacacttcgactggaactctgacaactacctgaaacacggacactacattccccaaggcggggttgaagagctgaaaaccttcgacgcgattttctttggcgcggtcggtgcgctcaacgtgcccgatcacatttccctgtggggcctgcgcctgccgatctgccaaggcttcgaccaatacgccaacgtgcgtccggcgcgggtgttgccgggggtgaaaagcccgctgcacaacggcgagcagattgactgggtggtggtgcgggaaaattccgagggcgaatattcgggcaacggtggtcgcgtacaccggggcttgccggaggaggtcgctaccgaggtgtcggtgtttacccgtgcaggcgtcgagcgcatccatcgttttgccttccagttggcacaaagccgtccgcgcaagcacctgaccatggtcaccaaatccaatgcccagcgccatggcatggtgctgtgggacgagattttctacgaggtcgccaaggacttccccgacgtcaggatcgacaaggaactggtcgatgccgtaaccacgcgcatggtgctcaaaccatcgacgctggatgtgatcgtggccaccaacctgcacgccgatattctgtccgatctggcggcggcgctgtccggcagcctcggcattgcgccgaccgccaacctcaatccgtcgcgcaacttcccgtcgatgttcgaaccgatccacggctcggcgttcgacatcaccggtaaaggtgttgccaatccgatcgcaacgttctggacggcggcaatgatgcttgaacacctgggtgaaaaggtcgccgcgaagcagttgatgtcggcgattgaggcggtcaccgagagcggcctgcatacccccgacctcggcggcacggccactacgcgccaggtcactgacgcggtgatcgcactgatcaaccgctgatttaccccgattcaaaacagtactgcggcacaacgccgaggggttttgcgaccccttggcatttcctgacaacaataaaaaatcagggccctgtcatgaaaagaatattcggcaaactgtacgtgcaagtcctcgtcgccgtgatcctcggcgcactcatcggcgtgctggtgcctgagaccggcaccgcgctcaaacccttgggcgatgcctttatcaaactgatcaaaatgctcctggcaccggtgattttcctcacggtggtcaccggcatcgcacgcatggaaaacatgaaggaactggggcgagtcggttttcgtgccctgatctacttcgaagtggtttcgaccctggccctggtgatcggcctgattgtggtcgatgtgttcaagcccggtgccgggatgaacgtcgatgtcgccagcctcgacaccagcagtctggcgacctacaccacggcggccagacacgcgtcgttcatggactttgtgatgggcatcattcccgacacgattgtcgatgcgttcgccaagggcaatgtcctgcaaatcctgctgttctcgatcctgctgggcatcgcgttggcgcatgtcgggccgcgtggcaaagtgtttgtcgatgcgctggagagtctgatgcagggcatgttccgtatcgtcaacatggtcatgcgcctggcgcctattggcgcgttcggtgccattgcgttcaccatcggcaaatacggcttcggttcgctgttttctctcggcaaactgatggcctgtgtctacctgacgtgcgcagtgttcgtggtcttcgtgcttggcccgatctgtcgctacagcggtttcagcctgtggaagttcctcaaattcatcaaggaagagctgttcacggtgcttggcaccagctcttcggaatcggtgttgccgcagatgatctcgaagatggaaaaggccggcgtctcgaaaccggtggccggaatgatcatcccgtcgggactgaccttcaacccggatggccaggcgatctactacaccatcgctgcgattttcattgctcaggcaaccaacacgccgctgaccctggccgatcaattgatcgtgctggcggtgctgatgttcacctccaaaggctcggcgggagtgaccggttccgggttcatcattctcgcggcgacactggcctcactcggcaccattccagtggcgggtatggtgttgctgctgggggttgaccggttcatgtcggaagcgcgggcgatcaccaacaccatcggcaacggcgtcggcaccatggccatcgccaaatgggtgggtgcgctggataccgagaagatgcacaaagcgctgaatggtgaagtcgaggagccggctgtgcatgtctcgcaaactgaaaagcccgccggtcaaactgcgcctctgatccccagccttaaacgagctgcccagaactgacgatgattgtttgtcggagcgcgcttgctcgcgaagaggccgtgtcagccaacatatcgggcgcctgacatagcgctttcgcgggcaggctcctattttttttgaagagggtatgcctgactcaacgctgtgctatatccaaagcctctaagcaactgtcagatctgacagttggcgccatcctcgctgcgatcaatcatgggggtcttcggtttcgccagggaagactctgcaatgaacatggccagccaaacgttgaccggtggtgtcgctgcctgcctgttggcaattaccctcaatgcgcgggcagaaacggagtacatctgtctggggcaggagcgtggacaagaggcaacggtgattgcagcttctgagccacaagctgccgcgctggcgaaagctcactggcggaccgccggttgttttaaaaagtgatcggcgcgatcaaccgcgatacgcaacgcctccagcagcaacgcaaacgccggtgctgcctgacgtctgctcgggtaatacaggtgatagccggcaaatgtcgggcaccagtcttcaagtacttgcagcaagcgtccatcggccagatacggcgcgacgatgttttccgggatgtagctcagaccaaaaccatccagcgcggcatccagcaacggatagacgccgttcagggtgacttgcccggtcacgcgcactttcaggctttcgccatccttttcgaactcccagctgtagagcccgccgttggtgggcaggcgcaggttgttgcaggcgtgatcggtcaggtcgcgcggggtttgcggagcagggcgacgggcgaaataggccggcgaaccgaccaccgccatgcgcatgtctgggccgatgcgcgtggcgatcatgccttgggcgacgtcttcgcccagacgaatgccagcgtcaaaaccttgcccggcgatgtcgacgaaaccgtaatcgcagctgacttctacgcagatgtccgggtacttgggcaggaagtctttgagcaccgggcgcagcagccagtccagcgaatggtcggtggcattgatgcggatcttgcctgccggtgtttcgcgcaggttgctcagggcggcaagttccacctcgatctcttcgaagcgcgggccgatggtttgcagcagatgttcaccggcctcggtgggggaaacgctacgagtggtgcgcgtcaacaggcgcaggccaaggcgcgcttcgagcgcccgaatggtatggctcaacgctgattgcgagacgccgagtttggccgccgctttggtaaagctgcgttcacgggccacggcgaggaaggcgagcaggtcggtggcgttttctcggagcattgatgagtttcctgcataagtttttttgaattctagtcgattatttgaagagtatggatcggtaaagtgcaggcattgattctctggaggacattgccatgaacccgattgctgcttctgcgttgaccctttccctgctggcgggtgaggtgcaggccaatgaacaaccgcgcgtgaccgtgatgcccaacggctcgcaaccttcggcccgtggcccggcggattggttcaccggcacggtgcgtgtcgatgcgccgttcaagggttcggatgcggcgcgggtcagcggcgcgacggtgacgttcgagccgggtgcgcggacggcgtggcatacgcatccgctggggcagacgttgatcgtcacggctggctcagggtttgtgcaggaatgggggcaatcggttcgcgagattcgccccggtgatacggtgtggattgcgcccggcgccaagcattggcacggggccgcgcccaccacggcgatgacccatatcgccatcgctgaagtgcttgatggcaaagttgtggattggatggaacaggtgagtgccgagcagtatccacaatccgagtaaaacctttccctcaccccagccctctcccggagggagagggggccgaccgaggtgtcttgcatcctccgccgacatgaaattgccgtgtcgattatggattcacagcaagacgtgcaggtcggtgcagctcttgaatatccccgaatcggttccctctcccttgggagagggttagggtgaggggctgtgctcaggcgtttagatcatttccggcaatgaagaaagaatcttgtccagcgtaatcgggtaatcccgcactcgtgccccggtcgcgttatagatcgcattcgccaccgccgcgctcaccccgcagatccccaattcaccgacgcccttggccttcatcggcgaagaaatcggatcggtttcatcgaggaaaatcacctcctgatggggaatgtcggcatgcaccggcacctcgtagccggccaagtcatggttgacgaaaaagccgagcttcttgtccaccgccaactcttccatcagcgctgcgccgacgcccatggtcatcgcgccgatcacctgactgcgcgccgctttcgggttgagaatccgcccggccgcgcacaccgccaacatccgccgcacccgcacttcgccggttgccgcatccaccgcgacctcaacgaaatgcgcgccgaaagtcgattgctggtactgctcggcaaggtcggcgaactcgatgctgtcctcggccgtcactgcgccgttttgcgcggcattgcgcaacggcacatgcttgtcgccaacacgcacctgaccgtcaacaaactcggcttgatccgccgccaaacccaacttgccagccaccgcctcacgcagtttcatgcatgcggcgtagacgccggcggtcgagcagttggcgccgaattgtccgcccgacccggccgagaccggaaaattcgaatcgcccaggtgcaccgtcacatccttcagacccacgcccatcatttcggcggcggtctgcgcaatgatcgtgtagctgccggtgccaatgtcggtcatgtcggtttccaccgtgaccttgccgtcacgctccaggcgcacccgcgcaccggatttgaccagcaggttgttacgaatcgccgccgccacgcccatgccgatcagccagcggccttcgcgacgcgtgccgggctgcggatggcgtttgtcccagccaaatttgtcggcaccggtttgcaggcattcgatcagccgtcgctgcgaaaacggccgctcggttttcaccgggtcgacttgggtgtcgttgagaatgcggaactggatcggatcaagtttgagctgctcggccatttcatccatggcgatttccagcaccatcagccccggggtttcaccgggggcgcgcatggcgttgccttccggtagatccagcggggaaaggcgcatgcttaccaggcgattttccgcggcgtacaacaattggctcggctgcgcggcgacctcgactttgccttccgcgaggttgcccgaccagccttcgtgggcaatggcggtgagtttgccgtccgccgtcgcgcccatgcgaatgtgctgaatggtcgctggacggtgggtggtgttgttggccatttgcgggcgggcgagggcgaccttcacgggtctacccgccatccgcgcgccgagggcggcgagaatggcgtcggcgcgcacgaacaacttgccgccaaaaccgccgccaatgtacggcgaaatcaagcggaccttttccttgggcaaaccgagggtggtggcgatgtcgccgacgctccaggcgatcatctgattcgatgtccacagggtcagttgatcgcctttccaggcggccagcgtggcgtggggttccatcatcgcgtgggactgatccggcgtggtgtaggtctggtcgaactgcactggcgcagcggcgaaggctttggcgaaatcgccgtgtttgacatcgggcaattcgtctttcggctcaacgccttggtcacgcacgctggccagatcgaacttgccttcggcggcaacgtaatcgaccttgaccatttgcgcggcagcccgggcctgctcgaaagtttccgcgaccaccagcgcaacggcctggtgatagtgctgaatctctggcccggccagcaacggcgcggcgttgtatttgcccttgccgagtttgccagcgttggcggcggtgacgatggcgagtacgccgggtgcggctttggcgtcctcaagatcgatgttgttgatccgccccttggcgatggccgagccgaccatgaaaccgtaagcctgattggccactgcctcgtgttgctcgtaggcataaggcgcctgaccgctggttttcagcggaccttcgacgcggtcagtgggttggccgatgaccttcaaccggtcgatcgggttggtggtggccggcgtgtcgaatttcatgcttcgtccctcgcttgcgccaacaccgaaccgagcgtgcgctcgaccagggtcagtttgaattggttgtcatgggtcggcgtggcaccgtcgagcagccgttcgctgacggctttggcgcctttgggcagcaaggcttcggcggcttcgacacgccatggtttcggcgcgatgccacccacggcgacacgtccgctgccgtccttttgcagaatcaggccgaccgataccagcgcaaaggcgtacgacgaacgatcacgcaccttgtgataaatatgcgtaccgccgacgggcaccggcagggtcacggcggtgatgaattcgccgggcgtgaggctggtttcgatgttcggcgtggtgcccggcaactgatggaaatcggccatggcgatgctgcgtttgctgccgtcaggtttgaccgtttcgatctgcgcatcgagtgcgcgcatggcgatggccatgtcgctcgggtgcgtggcgatgcacgcctcgctgacgccgatgacccccagttgtcgactgaccccgccaattgccgcgcagccgctgccgggttggcgtttgttgcaggcctgattggtgtcgtagaagtacgggcaacgcgtgcgttgcaacaggttgccagcggtcgtcgccatgttgcgcaactggccggaagccccggctagcaaggcgcgggagagcagcgcatagtcttttctgatgcgctgatccgccgccagatcggtgttgcgcaccagcgcaccgatgcgcaaaccgccctcgggcgtggcttcgatttgatcaaggcccaagtgattgacatcgatcaggtgcagcggggtttcgatgtcgagtttcatcaagtcgagcagattggtgccgccggcgataaaacgcgcgccttcggcctgcgccgcttgcgcagcggcggcgggagaatcggcgcggctgtaactgaacggcctcatgctggcacctccgcgacttcagtgatggcttcgatgatgttcgagtaggcgccacaacggcagatattgccgctcatgcgctcctgaaactcactggcgatcagttgcggcggctcggtcaagctggcgctggcgtggctggggatgccgtcgcggatctccttgatgacggcgactgccgagcagatctgccccggcgtgcaataaccgcactgatagccgtcgtgcttgatgaacgcggcttgcatcgggtgcaatttgtcaggcatcccgaggccctcgatggtggtgacgtcactgccttcgtgcatgactgccagggtcaggcaggaattgatccggcggccatcggcgatcactgtgcaggcgccgcactggccgtgatcgcagccttttttagtgccggtcagttgcaggtgttcgcgcagggcatcgagcagggtggtgcgggtatcgacgtccagttcacgcggtttgccattgacgttgatcgtcactttgctcatggccggttgctccaggttggccgcataggccttgaggctgataaacggcggcatggcgaatgccgttgcggtgacggcgccaaggatcagaaatctgcgtcgggaaatcgtcatggttcgattcctttttctcaatcagggcagcagggggcaagtggcccaaacgggcatgccggcgtgttcaccggtctcgttaaggaatgactgctgaagagaggaaaaggtttttgcggattttcgctatagagttatgagttttgttcattaatcgggtgttggaggggaagatcataggatcgcagccttcggcagctcctacacgaatccctgtaggagctgccgaaggctgcgatcttttgatcttgaaattgcaaaaaaaacggcacccgaaggtgccgtttttgtttgtagcgctcgagctgtcagcccgccagacccgcctgctgaaccagagtcagcaatggctgcgggtacacacccaggaagaatgcgaccagggcgatggccagcagcatcacgccgccggccttctgttcccagtgcaattgggcgtcgtggcgacgcaggtttggctcgatcaggtacagggtgaccatcacgcgcaggtagtagaagacgccgatggcgctgcccagtaccaaggagccgaccagccaccattggtgcgattccacaccggtagcgatgatgtagaacttgccgatgaagccagcagtcagcgggataccggccagggacagcatcatcacggtcagcacggcggtcaggtacgggcggcgccagaacaggccgcggtattcgtacagggcatccgcgtcacggccgttgtacggcgaggacatcagagtgatcacgccgaacgcgccgaggctggtgatcacgtaggtgaccaggtacacgccgatggcttccaccgccagacctttgctcgccaccagtgcgatcagcaggtagccgaagtgcgcgatggacgagtaaccgagcagacgcttgaggttgctctgggtcagggccagcaggttaccgaacaggatcgaggcgatcgcgatgacggtcagcacgtcgctcaatacgccgctgctggcggcaggggagatctggaacagacgcaccatcaccgcaaacaccgcaaccttcgacgcagtcgcaaggaacgcagccaccggtgccggagcaccttcgtaaacgtccggcgtccacaggtggaacggtacgagcgacagcttgaacgccagaccgatcagcatcatgcccaggcccagttgcgccagcgagctaggcaggccagtcgcagccagggcctgaccgataccgacgaagctcagcgaacccgagtcggcgtacagcagcgccataccgaacaacaggaacgcggaaccggcggccgacagcaccatgtacttgatgccggcttccagcgaacgcttgttgaagaaggcgtaagccaccagaccgtaaaccggtaccgagagcagttccaggccgatgaacaaaccggccaggtgctgcgcgctgaccagaaccaggccaccggcggcggccatcaggatcagcaggtacagttcttcacggttgcccgggtaacccgaaccgccatcgcccagataggcgtgggcgagggtgacgcaggcgagggtggcgaccaggatcagcgccatgtacaggcaagcgaacgtgtcgatttgcagcagtggagtcacggccagaggcgcgactttcagggctggcaggatcgacaacagggccaggttcagaccggcgaccgagatcaggaaggtctgcgagtggttgcggcgccaggcgattgccagcatcaccacgataatggtgaggctggtgatcaacagtggcgcaagcgcaataaagtgttgaatcgtgaattccatagcgctcttaccgggccgaagcgagttgagtgaaggcggtgccgagccactgctgaacgccatgcatcgtggcggcagaagtgtcgaggaacggttgcgggtagacgccgatgtagatcagcaacaccgcaaggcctagcaccatgatcagttcgcgagcgtccataccgtgcaggatcgaatccgatttcgccggaccgaagtaggcacggtggatcatgatcagcgagtagaccgaaccgaacaccaggccggaagtggcaatcgcagtgatccacggccagctggcgaaagagccgatcaggatcaggaactcaccgacaaagttaccggtacccggcaagcccaacgaggcggctgcaaagaacaggctgatcgccggcaggtaagcgatacgcgaccacacaccgcccatctcacgcatgtcccgagtgtgcagacgctcgtacaactgaccgctgaggataaacagtgccgccgccgacacaccgtgcgcgagcatctggatcactgcaccttgcagggccagttggctgccggagtagatgccgatcaacacgaaacccatgtgggaaacggacgagaaggcgatcagacgcttgatgtcggtttgtgcgaaagcgaggaacgcaccgtagaagatcccgatcagaccgagggtcatggcgatcggcgcaaactcggccgaggcattcgggaacagcggcagggcgaaacgcagcagaccgtaagcagcggttttcagcaagataccggcgaggtcgacggaaccggcagtcggcgcctgggcgtgagcgtcaggcaaccacgagtggaacggtacgactggcagcttgaccgcgaaggcgatgaagaagccgagcatcaggatgtactcggtggtcatcgacatcttggttttcaacaggtcggcgtagttgaaggtaatcacgccagtgttgttgaagttgaccagcaccagaccgaggatcgccaccagcatgatcaggccggatgcctgagtgaagatgaagaacttggtcgccgcgtagatccgggttttcttgccgtccgaagaactgtgaccccagagcgcgatgaggaagtacatcggcaccagcatcatttcccagaagaagaagaacatgaacaggtcgagggcgaggaacacgccgacaacgccgcccaggatccacatcaggttcaggtggaagaaaccaacgtgacgttgaatctctttccacgagcagagtaccgagaggatacccagcagaccggtcagcaggatcatcaacagcgacaggccgtcgagggccaggtgcacgttgatgccgaagcgctggatccagacatgcttgaactcaagcgcccaggtcggatcggcgccaggcgccggggcaaatgaatagtcaccgtgggcccacagccagaggccgagggcgagttccagggtcatggtcaacagcgcaatccagcgcgggagggtagcgccgaagcgctcacccatccagcacagcaggccgccgatgaaggggatcaggattagccaaggcagaatcatgacgggctcgtttcctttcgcaaattcgcaaggttcatatcagaccgctaccagcacgatggcgccgataaccagcacggcaccagcagccatggaagccgcataccaacgcagttgaccggtctcggtgcggctcagggcagtgtgaccacccttggccatacgcgggatcagaccgatggtctggtcgagcgggtctttgcgcagtacgtggctgatcgcaaggtacggcttgacgaacagtttgtcgtagatccagtcgaagccccaggcagcgaaccaccaggccgaaaggaaacggccgatgccgctgttggcgatggccgtgacgaagcgacgcttgccgaggaacagcagcgctgccagcaggataccggccagagcgatggcgcccgaagcgatttccagactgtgcttggcttcgccaccggcatgcccaacgctttctggtagcacgccatgcagcggtggcacgatcatggcgccgacgaaagtcgacagtacgatcagcaccgacagtggcagccagtgcgagatgccgtgaccggcgtgggcttcagtcttggcttcaccgtggaacgtgatgaagatcaggcggaaggtgtacagcgaggtcatgaatgcgccgaccagacctgcgtaaagcagaccgtggttgccgctggcgaacgcttcccaaaggatttcgtccttggagtagaagcctgcggtgaccagtggcagggcagccagtgccgcgccgccgacgatgaagctggcgtaggccagtggcagttttttccacagaccgcccatcttgaagatgttctgctcgtggtggcaggcaacgatcaccgcaccggaagcaaggaacagcagggccttgaagaaggcgtgggtcatcaggtggaaaatcgcgccatcccatgcaccaacgcccagcgccaggaacatgtagccgatctggctcatggtcgagtaggcgaggatacgtttgatgtcggtttgaaccagtgccgcgaaaccggccagtaccagggttacgccaccaacgatgccgaccaggtggaggatttccggcgccagggtgaacaggccgtgggtacgggcgatcaggtaaacaccggcggtcaccatggttgcggcgtggatcagtgccgaaaccggggtcgggccagccatcgcgtccgcgagccaggtttgcagcggcagttgtgccgatttaccgactgcgccacccagcaacatcagcgtcgccagggtgatccagaagtcgccgacctggaatttctgcggtgccagcaccagcagttcctggatgttcagcgtgcccacttgctggaacaggatgaacaggccgatggccatgaacacgtcgccgatccgggtcacgatgaaagccttgagtgcggcgttaccgttgttgcggttgctgtagtagaaaccgatcaacaggtacgagcacaggcccacgccttcccagccgaagtacaggaacaacaggttatcgccgagtaccaggaacagcatgctggcgataaacaggttggtgtacgagaagaagcgcgagtagcccgcttcgccacgcatgtaccaagacgcgaacaggtggatcaggaaaccgacgccaacgaccacgccgagcatggtgatcgacaggccatcgacgtagagggcgaagtcaggcttgaagccttcgaccgccatccacttccacagcaccagggtgtagtgaccgccttcgggtggcgcgacgttgaattgccagatgacgtaggcggcgacaatcgccgacaagccaatggaacccacgccgatcagcgccgagaggttttccgaccagcgtccacgggagaacgacagcagcaggaaaccgatcagagggaatacgaaagtcagaaagatcaggttcatccgcgcatctcactggcagcgtcgatatcgagcgtgtggaagcggcgatacagttgcagcaggatcgccagaccaatactggcctcggcggctgcaaggctgatcaccaggatgaacatgatctgtccatccggctggccccaacgggcgcctgcaacaatgaacgccagtgcagaggcgttcatcatcacttccagactcatcaacacgaacaaaatgttgcggcggaccatcaggccgaccagaccaaggcagaacaggatgccggcgacggccagtccatgttcgagagggatagcaggcatgacttactccttcgcctcgttacggcccaaatggaacgccgtgacggctgcagcaagcagcagcatcgaggcgagttcgaccaccagcaggtacgggccgaacaggctgatgcccacggctttcgcgtctacggtggtgtggccgatggcttgaccgctctggtgagcgaacagcacatacagcagttcggccagcagcagcccggcgagaatcaccggccctgcccagataccgggcttgagccaggcgcgttcttgctgaaccgcggcggggccgaggttcagcatcatcaccacgaacacgaacagcaccatgatggcgccggcgtaggcgatcacttccagcacgccggcgaacggtgcgccgagtgcaaagaaggtcatggccacagcgatcaacgagatgatcaggtagagcagggcgtgcacagggttggtgttggtgaccacacgtagcgtggccacaacagcgatacccgatgcgaaatagaaagcgaattccatcgttcttccttaaggcagcaagctcttcacgttgatcggttcggcttcgttctgtgcggcgcctttcggcttgccagcgattgccatacctgcaacacgatagaagttgtaatcagggtttttgccggggccggagatcaacagatcttctttctcgtacaccaggtcctgacgtttgaactcggccatctcgaaatccggtgtcagctggattgcggtggtcggacaggcttcctcgcagagaccgcagaaaatgcagcgcgagaagttgatacggaagaagtccgggtaccagcgaccgtcttcggtttcagctttctgcagcgagatgcaacccaccgggcaagccacggcgcacaggttgcaggcaacgcaacgctcttcgccatcggggtcacgggtcaggacgatacgaccacggtagcgtggtggcaggtagaccgcttcttccgggtattgcagggtgtcgcgcttgcgaaagccatggccgaagaccatgaccaggctgcgcaactgggtaccagtacccttaacgatgtcgccaatatatttgaacatgggtcaaatcctcactgaaccgcgactgctggcgtgttccacaacacgactgcagcggtcaccagcaaattgatcagggtcagtggcaggcagaatttccagctgaaatccatcacctggtcataacgcggacgcggaatggaagcgcgcagcagaatgaacagcatgatgaagaacgcggtcttcagtgcgaaccagaggaaggacagttgcggcaatatgccgaacggaccatgccagccaccgaagaacagggtgaccagcagcgccgagatcaggatgatgccgatgtattcaccgacgaagaacatgccccatttcataccggcgtattcaatgtggtaaccgtcggccagttcctgttccgcttccggctggtcgaacgggtgacggtgagtcacggcgacgccagcgatgaagaaggtacagaagccgaagaactgcggaatgatgaaccacaggttctgcgcctggtactcgacgatgtcgcgcatgttgaacgagccgacctggaccacgatgcccatcagggccaggcccatgaacacttcgtaggacacggtctgcgccgaagcacgcagcgcaccgagcagggcgaacttgttgttactcgaccagccggcgaacaacaccgcgtagaccgacagaccggccatggcgaagaagaacagcaggccgatgttcagatccgcgacgccccaggtcggggtgatcgggatgatcgcaaacgcgatcagcagggcggacatggctacaaccggcgccaaagtgaagatcactttgtcggcaaacggcggggtccagtcttccttgaagaacatcttcagcatgtcggcggcgatctggaacatgccaaacgggccaacgcggttcggaccgtaacggtcctgccaccagcccagcaggcgacgttcgacaaagctgagcaacgcgcccgcgaccaccacggccagcagaatcacgatggctttgacgaccgtcaggatcacatcgatcacttcaggggtgaaccaggtcattgcgctgcctcctgcagaccgtcgacggatacgccggcgaatgccggtggaatgccggcgatgcccgcaggcaaccccaccagaccggcgcccagttcttcattgatgcgcagcggcagacgcagggtctgaccggccacgttcaggctcagcagggcaccgtcgttgacgccgagacgatccgcttcggacttggccagtgccacgtaagcagccggaatacgctcttgaaccggtgcggctttcgaagagttctcttcgctgccgaacaggtggaagaacggtaccgcttgccaggttcccggcgccgggttgaatgcgcgcggtgcagcagcgaaccagttcagcgagtcgccagtgctttcgatcaggcgggtgcccgggtcgcctgcacggatgtgaccaccaacttcgtcctggaacttgttccacgcttgtggcgagttccagcccggcgaccatgcaaatggcacctgctgacgcggttcggcagagcccgagtaaccttccatggagaaggcgaacgcggtgtctttgtcttgcggggtgcgtggttcgtgaacgctgatgtcggcgcgcattgcggtgcgaccggagtaacgcagcggctcacgcgccagtttcagacccttgatgcggaacgccgccgatggtgcagcgtcgacgatacgtgccagttgctcggtgctcgaagcaacggcagcggtgacgtggtcgagttgcgtccagtcgatcggctggttcagcaaggtcgcgcgcagggcgtgcagccagcgccagccttcgtgaaccagaatgctcgcgtcgaggtattgcgggtcgaaaacctggaagaagcgctgggcgcgaccttcctggctgaccagcgtaccgtcgccttcggcgaagcttgccgctggcagaaccaggtgcgcgcgatcgctggtcgcagtcttctgatgatcagcaacgatcactacttgcgcagcgttcagtgcagcatcgaccttgtctttggcggtgcgggtgtacagatcgttttccagcacgacgatagcgtcagccttaccgtcgatgacggcttgcagcgcagcgtcgaccgattcgccaccgagcatggccagaccaaggctgttggcttccggcacgatcaggctgatcgaaccgtttttctcgcgcagcttcagcgctttggcgatgttcgccgcggcttcgatcagcgctttggagcccagcgaagtaccggcgatgatcagcggacgttttgcagcgagcagggcgtcagcgatgcgcttggccagttccagtgcttcagcgtccagaccttcaacggccggggcgctggcgtccagtgcgtgagcaacggcaaaaccgatgcgcgccagatcgtcaggcgctgcgtgtacgcattcttcagcgatgtcgtcgagcttggtttccgccaggctggcgatgaacagcgggttcagcgcgtgctgaccgatgttcttcacggcggcgtcgagccaaggctgaacgcgcatggcttcggccatgtcttcagctttgcccttgaccgattgacgcagcgacagcgccacacgggcggcggtctgggtcaggtcttcaccgaggacgaaaatggcgtcgtggtcttcgatgtcgcgcatgttcggcacaggcagcgggctgtctttcagcacttgcaggaccagacggatgcgttccagttcggaggcttcgatacccgaatagaagtgctcggcgccgaccagttcgcgcaacgcgtagttgctctcgaggctggcacgcggcgagccgataccgacgatgttgcgaccgcgcagcaagtcagcggctttatccagtgcagcatccagaccgagcttggtgccgtcggccagcagcggctgacgtggacggtcggtgcggttgacgtagccataaccgaaacggccacggtcgcacaggaagtactggttcaccgaaccgttgaaacggttttcgatgcgacgcagttcgccgtaacgctcgcccggggagatgttgcaaccgctcgagcagccatggcagatgctcggcgcgaactgcatgtcccacttgcggttgtagcgttcggagtgagtcttgtcggtgaacacaccggtcgggcagacctcggtgaggttgccggagaactcgctttcgagggtgccgtcttcaacgcgaccgaagtacacgttgtcgtgggcgccgaacacaccgaggtcggtgccgccagcgtaatccttgtagaaacgcacgcagcggtagcaagcgatgcagcggttcatttcgtgggaaatgaacgggcccagttgctggttctggtgggtgcgtttggtgaagcgataacggcgctcgttgtggccggtcatcacggtcatgtcttgcaggtggcaatgaccgccttcttcgcacacagggcagtcgtgcgggtggttggtcatcagccattcgacaacactggcgcggaacgccttggattcttcatcttcgatggagatccaggtgttgtcggtggcaggggtcatgcaggacatgacgatgcgaccacgggtgtcgttctcgtcggtgtactgcttgaccgcacactggcggcaagccccgacgctaccgagcgcggggtgccagcagaaatatggaatgtcgaggcccagcgacagacatgcctgtaacaggttgtctgccccgtcgacttcgagcgctttgccgtctacgtggatagtggccatggttcaaaggtcttcgttggcccggtgtcagcgggcgtggctaatggaatcttgttatccgtgcgaatcaaaccagcctcgaaaggcgtcatcgcaggaggtgaaaggcccaggcccttcaccttattaagcgtttacgcgccgattacgatcggccttgccagaggcgggacggcggcgctgactggcgcgataccggcttcgaactctggacggaagtatttgatggcactgcccaacggttccacggcacccggtgcgtgagcacagaaggtcttgcccgggccgaggaagttgaccagacccagcagggtctcgatgtcgcctggctgaccgcggccttgttcgatggccatcagcagcttgacgctccatggcaaaccatcgcggcacggggtgcagaaaccgcacgactcacgggcaaagaactgctccatgttgcgcagcaacgagaccatgttgacgctgtcgtccaccgccatggccaggccggtacccatacgggtgcccactttggcgatgccgccggcgtacatttgcgcgtcgaggtgttctggcaggaggaagccggtaccggcgccacctggctgccaggccttgagcttgaagccgtcgcgcatgccgccggcgtagtcttcgaacaactcgcgtccggtgacgccgaatggcagttcccacaggccggggtttttcactttgccggagaagcccatgagcttggtgcccatgtcttcgctgccttcgcgggccaacgatttgtaccagtcaacgccgtcggcaatgatcgccggcacgttgcacagggtttccacgttgttcacgcaggtcggtttgccccacacgccaacagcggcagggaagggcggcttggagcgcgggttggcgcggcggccttcgagggagttgatcagtgcagtttcttcaccgcagatgtaacgcccggcgccggtgtggacgaacagctcgaaatcgaaaccgctgccgagaatgtttttacccagcaggcccgcagccttggcttcttccacagcacggttcaagtgcttggcggcggtggtgtattcgccacgcaggaagatgtagccacggtaggttttcagcgcgcgggcactgatcagcatgccttcgatcagcagatggggcagttgctccatcagcatgcggtctttccaggtgttcggctccatttcatccgcgttgcacagcaggtagcggatgttgatggattcgtctttgggcatcaggccccacttcacgcccgtggggaagcctgcgccgccgcgacctttcaagcctgcatctttcacggtctggacgatggcgtcctgatccatgtcggcgaaggctttgcgtgcagcggcgtaaccgttcttggcctggtactcgtcgagccacacggcttcgccgtcatcgcgcagacgccaggtcagcgggtgagtctcggccgaacgctgaatgcggttggcaggaccgaaagatgtcagggtcatacgtagccctcgagcagtttggcgacgccagcaggctgcacatcaccaaaggtgtcgtcgtcgatcatcagcgccggtgccttgtcgcagttgccgaggcagcagactggcagcagggtgaaacgaccgtcggtggtggtctgacccaggccgatgcccagattgttctggatttcgctgaccaccgactcgtggccaccgatgtagcagaccatgctgtcgcagacgcgaatgatgtgacggccaaccggctgacggaaaatctggctatagaacgtcgccacaccttcaacgtcgctggccgggatgccgaggatctcgccgatcgcgtacagggcgccatccggcacccagccgcgttctttctgaacgatcttcagggcttcgatcgacgccgcgcgcgggtcttcgtagtgatgcagctcgtgctcgatggccgagcgctcggtttcactgagggtgaaacggtctgtctggataagcgtgctgttcatgcttagcggtccacgtcggccataacgaagtcgatactacccaggtacgcaatcaagtccgcgaccatgctgcctttgatcaccgaagggatctgttgcagatgcgggaagcttggagtgcggatccgggtacggtagctcatggtgccgccgtcgctcgtcaggtaataactgttgatgcccttggtcgcttcgatcatctggaaggattcgttggccggcatcaccgggccccacgaaacttgcaggaagtgcgtgatcaaggtttcgatgtgctgcagcgtgcgctctttcggcggcggcgtggtcagcgggtgatccgccttgtacgggccttccggcatgttgcgcatgcactggtcgatgatcttgatgctctggcgcatctcttcgacgcgaaccatgcagcggtcgtaggcatcgccgttggcggccagcggtacttcgaactcgaagttctcgtagccggagtatggacgcgctttgcgcaggtcgaaatcgcaaccggtcgaacgcaggccggcaccggtgacgccccattccagggcttctttggtgttgtactgggcgacgccgatggtacgacccttgaggatgctgttctgcagggcagccttggtgtattcgtcgaggcgttttggcagccattcaacgaagtctttcaccagtttttcccaaccgcgcggcaggtcgtgggcaacgccaccgatgcggtaccaggccgggtgcagacggaaaccggtaatggcttcgatcaccgtgtacgccttctggcggtcggtgaaggtgaagaacaccggcgtcatcgcaccaacgtcctggatgtaagtacccaggaacagcaggtggctggtgatccggaagaactcggccatcatgatgcggatgacgtcgaccttctcgggcaccttgatgccggccagcttctcgaccgagagcacgtacggcaggttgttcatcacgccgccgaggtaatcgatacggtcggtgtacgggatgaaactgtgccaggactgacgctcggccatcttctcggcaccacggtggtggtaaccgatgtccggtacgcagtcgacgatctcttcgccgtccagctgcagaatgatgcggaacgcaccgtgcgccgaagggtggttcgggccgaggttgaggaacatgtagtcctcgttcgtcccggagcgtttcatgccccagtcttcaggacggaagcgcgcggcttcttcctcaagctgttgcttggcgaggttgaggctgtacggatcgaattcggtcgcacgcgccgggaagtccttgcgcagcgggtgaccttcccaggtcggcggcatcatgatgcgcgacaggtgcgggtgacctttgaagtcgataccgaacatgtcccagacttcacgctcgtaccagttggcgttcggccagatgctggtgacggtcggcaagctgaggtcgctttcggacaaggcgaccttgatcatcacgtcactattacgctccagcgacatgaggtgatagaacacggtgaactcggcgtcgctcggcaggccttgacgcttggtgcgcagacgctcgtccacgccgtgcaggtcatagagcatgacgtacggcttgggcaggttgcgcaggaaagtcaggacttcaacgagcctggcgcgcgcaacccacagcaccggcatgccggtgcgggtcgactgagcggtgaacgcttcggcgccaaaacggttgttcaattcaacgaccacatcctggtcgtctgccttataaggcgggatgtacagagcgctgcctgtagtcatggttattttttcgctttcggtcaacgtaaagaatgaagccagcttctcgtttcttttttaagaacagatctggatcagacttcgtcagggctgcgcagattggtgactgcgattcgctgttcgcggcgctgttccttctgcgaaggcatgtcggcgcgataaacgccttgatcaccaacgacccaggaaagcgggcgacgctcctgtccaatcgattcctgcaacagcatcaagccttgcagaaatgcttctggacggggcgggcagccaggtacgtagacgtccacgggcaggaacttgtccaccccttgaaccacagagtagatgtcgtacatgccaccggagttggcgcacgaacccatggagataacccacttcggctcgagcatctgctcgtagagacgctgaatgatcggcgccatcttgatgaagcaggtaccggcgataaccatgaagtcggcctgacgcggcgatgcccggatgacttcggcgccaaagcgcgcgatgtcgtggggcgccgtgaaggcggtggtcatttccacgtagcagcacgacaggccgaagttgtacggccacagggagttcttacgtccccagttgaccgcgccactcagcacgtcttccagcttgcccatgaaaatgtttttgtggacttgatcttctaacggatcggaaacggtttcccgttcgccaatcggatactgctcgttaggagcatcggggtcgatcctggtgagattgtattgcattgccaaagcctcattgtttcagcttcgcctgccgcttgcgacgagcttccggagcccagtcaagggcgcccactcggaacaggtagacaagacctgccaacagaattgctatgaaaacgagagcttcgacgaatccggtccagccgctttcgcggacggacacagaccatgcaaagagaaagagggcttcgatatcgaagatcacgaagagcatcgcgaccagatagaatttggctgagagccgcaagcgggcgccaccggtaggtagcatgccggactcgaacggttcgtttttgctgcgaccccaggcttttgacccgaggaggctggagacgccaagcatgaaggcacacaggccgacgacacccagaaggaaaatggcaaagccccagttgtgggccatgagtcctgtcgcttcgggcatgctggtaatccttaacagagagcaaaggtctctgagcttgataaagaaataggcagtgacgatatgtcgcagcaatcaatcgcgctgattttatggctaaacaccctgcaagtaaaattcctatagcgaaattatttattggaataaggacatagcgcatctccactgccctgcagcccatgcgttgcgggcattaggcgggtttatgcaaataatgttttgtagggaatgtaacgaacatagttgctgctaaatgataattgatatcgtttggagtggttttgtaactgtttaacgggatggaagttgggaagttgtcttacttgcgcgttactgcaagtagcgacggcgcccgttttagcggatttttctgacggctgatccgatctggatcaatgttttctccgaacgacgccgatccctgtaggagtgagcctgctcgcgatagcggtgggtcagtcacagtatgcgcaagctgacacacctctatcgcgagcaggctcactcctacagggatttgtggtgttcattaaatcggggcaaaaaaacgccccgaaccagtcggggcgtcagtttttcggctctgcggttagctttctattcgatccgcaggggccgtttgctcaggcgaagcagatcagtggaactgttcttcttcagtcgaaccggtcagtgcggttaccgaagacgagccaccttgaatcacggtggtcatgtcgtcgaagtagccggtgcccacttcctgctggtgagccacgaaggtgtaacccttggcggcgtcagcgaattcctgctcttgcagcttcacgtaggcagtcatgtcgttgcgggcgtagtcgtgcgccaggttgaacatgctgtgccacatgttgtgaatgccggccagggtgatgaactggtgcttgtaacccatggcggacagttcgcgctggaacttggcgatggtcgcgtcgtccaggtttttcttccagttgaaggaaggcgagcagttgtacgacagcagttggtccgggtattcctttttgatcgcttcagcgaagcgacgagcctcgtccagatccggcttggcggtttcgcaccagatcaggtcggcgtatggcgcgtaagccaggccacgagcgatggcttgatcgaggccagcgcgaaccttgtagaaaccttcctgagtgcgctcgccagtcacgaacggctggtcgtacgggtcgcaatcggaagtcagcaggtcagcagcgttcgcgtcggtacgggccaggatgatggtcggcgtaccggcaacgtcagcggccagacgtgcagcggtcagcttctgtacggcttcctgggtaggaaccagtactttaccgcccatgtggccgcattttttcacggaagccagttggtcttcgaagtgaacgccggcggcgcctgcttcgatcatgctcttcatcagctcgtaagcgttcagaacgccaccgaaaccggcttcagcgtcagccacgatcggcgcgaagtagtcgatatagccgtcgtcgcccgggttcttgccggctttccactggatctggtcagcacgacggaacgagttgttgatgcgcttgaccacggttggaaccgaatccaccgggtacagcgactggtccgggtacatggattctgcggagttgttgtccgcagcaacctgccagcccgacaggtagatcgcctggataccggctttaacctgctgaacagcctggccaccggtcagggcgcccatgcagttgacgaaatctttctcaggacggaaggacggcttggcaccctgggtgaccaggttccacagcttgtcggcgcccatttttgcaaaggtgtgctcaggttgaaccgagccacgcagacggacgacgtcagcagcggagtaagtgcgtgtcacgcctttccagcgcgggttttcagcccagtctttttcgagggctgcaatttgctgttcgcgtgtcagtgccatggagataaacctcgtcgcgtcttttatgaaaagttgttctgcggtggaaaattcctgcgctcgctgaccagaagcttaggtggtcaagtcggtttcggcggggtaggcgacgggatgaacgatgggctcgaggggaagtgagcaggtagtggcggactgcgggcgcatgcgggcgtcgtgggcctttatacggtctacagtgtggagccgggttacctaattacgcttccgtccctcgggacaacttcgttccagtcggcaacctcgtcaaacacaccttgtgggcggtacagacacgaaacggttcgcggggtaggtgcgaacatcgcttcgaaggcccttgccagggcctctgattagcgggagcgaggccatcatgccttcgcttttttgcctcgtcaaacgttttgtagtgctttttttcaagcactacatctttcgtctaatacgactaatcagtcagttttcggtgctttagtccaacgtgtcgactttgacccgcaaggtcatgtcatcccgaccttgagtcgagtagctgcgggtcaggccctgtttgtcagcctgggtctggctgttgacgccggcgagggtgatccattcaccgaggcgtccgctgacagttgtgtcggtactttgtacgttcactacatcggaacgttcctggctcattcggtcattgttggtagtgatcgccaggtgaacggtgtcgccggtgacgctggcggtgacgtaaaaccctcgagtgacgttgcggtattgggtctggctgttgtaaccgccataggaatcgctctgcacgttggtgatcggcacgctttgcccgacctggatcagcgctggcatgccttcgctggcttgcacctgttgcacgccgccgttacggctggtggtgctgcggctgatgatgcgggtctgacttggctgggcgccattgaccgaataaccctcgtcgccccgaccattgttttcgttggtgtcgacggtgatcagcaggcgcttgggcgcggtgtcgagttgggtgatcagcgccttgagttcctggatcttgtccggctctgccttgatgatcagttgattgccgtaggcgctgacttgaccgtccttgccgaggaagtcttgcgccattggcagcatgtcggtgctggtgcggtaattgagaggcacgatttctgtggctgccatcaccgaaaaactgcagccgagcagcagggtggtgagcagggtgcgtagggacatgtccgttatctccgctttcgaaaggcttgatattgccagtttgtcggcctggggtggggcaagttgaatcgtagacagcaaaacgccccggcatcggttgatgtcggggcgttttggggtgtgcttgcgggcgccatcgcgagcaggctcactcctacagggaatcgcatttcaattgtaggagtgagcctgctcgcgatcgccgcgccgcggtcttatgccgaatggcgaaccatgtcgacatgcggaatcccggcttcgaggaattcctcgctgaccaagctgaagcccagacgctcatagaacgccgtggcttgcacctgcgcgctgagcatttgctgcttcaacccgcgttcttccgcttcagcaatcaccgcttgcatcagcgcatcaccgactttcatcccgcgccagtctttcagcacggaaacgcggccgatgtgcccatcaggcaacagacgcgcagtgccaatcggaaagtcgccttcaaacgccagaaaatgtacggcggtcgcgtcatccgcgtcccattccagctcaggtggcaccgattgttcggcgatgaacaccgtttcacgaatgcgccggatctcggcgatgtccttctgccagtctgcgacacgaacgcgaattttattcatcagcgaaccccaggctaccttgcttgaccagttcgcagagcaggccgcgaccgtcttcgtcgttcagccactcaccgaggttctcggtgtgcagggcgtcagcggcgcagatcagcttcagcagttcgcgcagcttgcccggcaggtaacggctctggccgctggcgaacaacagcagatcgtcatcgacttccgaccacgccagacgcgcgctcgggttgcggatcaagatggcgccatcctgcagagcgctgaggaaatcttcttcttcgacgtcttccgggccaaccaccagctctggataacgcggctcggtcatgtactggccgaaccaggtcagcagcagacgctcgtcgctcatgtgctcggcgagcaggcttttcaggcgatccagcgcatcgtgctgaatctggtgcggatcgacggctggcttggcgtcagcatcggtgtagcgctcttcgtcagtcaggaactggctgaggaaatcggtgaagtgggtcagcacttcagaggcgctcggcgcgcggaaaccgaccgagtaggtcatgcagttgtcgaccgcgacaccgcagtgagccagacgcggcggcaggtagagcatgtcgcctggttccagaacccattcttcggtttcgtggaattcggcgaggatgcgcagatcggcgtgttgcagcaacgggctctcggaatcgcacatctggccgattttccagttgcgcttgccgtggccttgcagcaggaacacgtcgtagttgtcgaagtgcggaccgacgctgccacccggggcggcgaagctgatcatcacgtcgtcgacgcgccagctcggcaggaagcggaagttttccagcagctcgctgacttccgggacgaattgatcgacggcttgaaccagcagggtccactctttttccggcagcttgctgaattcgtcttcagcgaacgggccgcgacgcagttcccatgggcgctcgccgtgctcgatcaccaagcgcgattcgacttcttcttccagggccaggccggccagttcgtcggcgtcgatcgggctttcgaagtcaggaatcgcctggcggatcagcagtggctttttctgccagtagtcgcgcaggaactcacgtgctgtgatgccgcccagaagttgaagaggaatatcgggattcatatgtaacctattgaaaaaaagcacttttcagacgggaataaaaacgcccggcgcggccgggcgtctcaaacggggcaaacggtcgatcagatgcgtttggcttgcgctacagcgttgccgatgtagttggccggagtcagttgcttgagctcggctttcgcttgcgcaggcatgtccaggccgtcgatgaaagtctgcagcgcttctgggctgatgcccttgccgcgggtcagttctttcagcttctcgtacgggttttcgatgttatagcggcgcatcacggtctggatcggctcagccaatacttcccagcacgcgtcgaggtcagcggcaatcttctgctcgttgagctccagtttgctgatgcctttgaggctggcttcgtaggcgatcacgctgtgggcgaagccgacaccgaggttgcgcagtacggtggagtcggtcaggtcgcgctgccagcgggagatcggcagtttgctcgccaggtgctggaacagtgcgttggcgatgcccaggttgccttcggagttttcgaagtcgatcgggttgaccttgtgcggcatggtcgacgagccgatttcgccagcgatggtgcgctgtttgaaataacccagggagatgtagccccagatgtcacggtcgaagtcgatcaggatggtgttgaagcgcgcgatcgcgtcgaacagctcggcgatgtagtcgtgcggttcgatctgcgtggtgtacgggttgaagcccaggcccagctcgtcttcgatgaaggcgcgggcgttggcttcccagtcgatctgcgggtaggccgacaggtgcgcgttgtagttgccgacggcgccgttgatcttgcccagcagcggcacggcagcgacctgagcgatctgacgctcgagacggtaaaccacgttcgccagctctttacccagagtggtcggcgaagccggctggccgtgggtacgcgacagcatcggcacgtcagcgaaacggatggccagttcgcggatggcttcggcggtctggcgcatcagcggcagcatcacgtcgtcacggccttcgcgcagcatcagggcgtgggacaggttgttgatgtcttcgctggtgcaggcaaagtggatgaactcgctgacctgggccagctccggcagcttggccgcctgctctttgagcaggtattcgatcgctttgacgtcgtggttggtggtgcgctcgatctctttgacgcgctcggcgtgctccagcgagaagttttcagccagttcattgagaacggcgttggcctcggcggagaaggctggcacttcaggaatgccagcgtgggcggccaggcgctggagccagcgcacttcaaccagaacacgggcacggatcaggccgtactcgctgaaaatcgggcgcagggcctgggttttgccggcgtagcggccgtcaacaggggaaaccgcagtgagcgaagaaagctgcatggggtgttctcggacagtcgggcaacgaaatggggcgcgtatcatacatgaaaaaatccgccggtccgttgccaactgaccggcgtattacgcgttacagactacaaagcttttattgcgtggcgtttactcgctgcgcatcaacggatacagctctttgagcagcttgcgccggctgatcaccaactgccagcgatgaccgccgagctgtcgccacaggcgtgccgaacgaatgccggcgagcagcagggcgcgaattttcgaagcgttgctcggttgctgcaggttgcgcatgtcgccgtgcacctggatgcgttggcgcagggtactcagggtgtcctgatacagcgcaccgcaagccgcgaccacgttttcgtgggccgggccgaaatgctcgacctgcgactggatctgcggcagacgcttgccgatggtgtcgagcatgtcgtcgcgcttggccagttgacgttccaggccgagcatcgacagggcataccgcagcggttcacgctgcaacgtactcgggtcgcgttcgagggcgccgatcagcgctcggtaaccttcacgcagattgagatcgtcgccgccgtacacgtccagcgtgtcctttgggtcgcgcaccagcagactgccgagcatgcaggtcaggccggcctcgctggtctggccggtcttggcgatccggtcgaccagcacagcggcgagaaacacgccgcccagcgccgtcagttgctcctgagtcgggctcatgcctggccgctccacggctcggccacttcgatcacgccgccaccgaggcagatttcaccgtcatagaacaccaccgattggcccggcgtcaccgcgcgttgcggttcgtcgaacacggcgcggtagccgttggcggttttttccagggtgcaggcctggtcactctggcgataacgcaccttggcggtcaggcgcagcggctggctcaggtcgatcgggttgacccaatagatttccgaagcgagcagggcgccggagaacagccacggatggttgttgccctggccgacgatcaattcgttagtgtccagatccttgcgcagcacgtaccacggctcatcgccggcgtctttcaagccgccgataccgaggccctggcgctgaccgatggtgtgatacatcaagccgtggtgacggccgatgacttcgccttcggtggttttgatctcgcccggttgcgctggcaggtattgcttgaggaaatcgctgaaacgacgctcgccgatgaagcagatcccggtggagtctttcttcttggcggtcgccagctcgtatttctcggcaattgcgcgcacttccggcttttccagttcgccgaccgggaacagggtcttggcgatctgttcgccgccgacggcgtgcaggaagtagctctgatccttgttcggatcgaggcctttgagcagttcggtgcggccatcgatgtcgcggcggcgcacgtagtggccggtggcaatcaggtcggcgccgagcatcatggcgtagtcgaggaacgccttgaacttgatctcgcggttacacaggatgtccggattcggcgtgcgcccggccttgtattcggcgaggaagtgctcgaacacgttgtcccagtactcggcggcgaagttggcggtgtgcagcttgatgccaatcttgtcgcagacagcctgagcatccgccaagtcgtccatggcggtgcagtattccgttccgtcgtcttcttcccagttcttcatgaacaggccttccacctcgtaaccctgctcgatcagcaggagagcggaaacggaagagtccacgccgccggacatgccgacaatgacgcgcttcttggatgtgtcagaaggggctggatcacgcatagggattcaatgagtgtcttgaaaaaggacgcgattctatcaggctcacggcctcaaggctaaagagaagggcggatcagttcgaggctgaagtgatggccggccagataatcgtcgatgcaacggatgatcagctcactgcgccagttgtcgcgctgggcgattaattcgtcgcgggtcagccacttggcgccgacgatgccgtcgtcgagctggtaatccgggtgatgtttgatggctttagcgctgaaacacacgcgttggtaggtcacgccgttgcttggggcggtgtacagataaatgccaatgacgccggtgggttcgacgtcccagccggtttcttcgagggtttcgcgcacggcggcttcgatcagcgtttcgtccgggtcgagatggccggcgggctggttgagcacattgcgcccggccttgtgttcttcgaccatcaggaaacgaccgttgtcctcgacgatggtggcgacggtgatgtgggggagccattccatgcggtgtcctcgtttctgaatattggaacccgatccctgtgggagctggcttgccagcgatggcggcctatcattcagcattgaaggtgactgatccaccgctatcgctggcaagccagctcccacagggttttgtggtgatcataaagcccggaaacacaaaccccggcacagggccggggtttgtgatgttccctttacaaccttaaaccagcgcagcaatcgccgcgttgagggttgcgcttgggcgcatggccttgctgatcagctcggcattggcgtggtagtaaccgccgatgtcgactggcttgccctgaaccgcgttgagctcggcaacgatggttgcttcgttctcggtcagggtttttgccagcgtcgcgaactgcgcttgcagtgcagcgtcttcagtctgggcggccagggcctgagcccagtacatcgccaggtagaagtggctgccgcgattgtcgatgttgccgactttgcgcgatggcgacttgttgttgtcgaggaactggccagtggcctgatccagagtcttcgacagcaccagtgctttcgggttgttgtagttcacgcccaaatgctcgagggatgctgccagtgcgaggaactcgcccagcgaatcccagcgcaggaagttctcttcaaccagttgctgcacgtgcttcggagccgaaccgccggcgccggtttcgaacaggccaccgccgttcatcagcggcacgatcgacagcatcttggcgctggtgcccagttccatgatcgggaacaggtcggtcaggtagtcgcgcagtacgttgccggtcaccgaaatggtgtccttgccttcgcgggtgcgctgcagggtgaacttcattgcgtcgaccggcgccatgatctggatgtccagaccggccgtgtcgtgatccttcaggtaggcctgaactttctcgatcactacgccatcgtgagcgcgcatcgggtcgagccagaagatcgctggcgtgctgctggcgcgagcacggttgacagccagcttgacccagtcctggatcggcgcgtctttggtctggcacatgcggaagatgtcgccggcttcaacagcctgttccatcagcaggttgcccttgctgtcggtgacgcgaaccacgccgtcagccttgatctggaaggtcttgtcgtgcgagccgtactcttcggctttcttcgccatcagaccaacgtttggcacgctgcccatggtggtcgggtcgaaagcgccattggctttgcagtcttcgatcacggcctggtagatggtcgcgtagcaacgatccgggatcaccgccttggtgtcgtgcagctgaccgtcggtgccccacattttgccggagtcacggatcatcgctggcatcgaggcgtcgacgataacgtcgctcggcacgtgcaggttggtgatgcctttgtcggagttgaccatcgccagcgatggacgagcagcgtagaccgcggccatgtcggcttcgatctgcgcttgctgctcggccggcagggccttgatgcgcgcgtacagatcgccgatgccgttgttcaggttgaagccgatctcggccagcacttcagcgtgcttggtcagggcatctttatagaactcggcaacgatctggccgaacatgatcgggtcggagaccttcatcatggtcgccttcaggtgcaccgagagcagcacgccctgggccttggcgctttcgatttcagctgcgatgaacgcgcgcagggcgtttttgctcatcacggcgcagtcgaggatctcgccagcctgaacggtggttttttctttcagaacggttgcggtgccgtctttggcgatcagctcgatcttcacggcgtcagcggcgtcgatcagggcagctttttcgctaccgtagaaatcgccggtgctcatgtgagcgacgtgggacttggagtctttggcccaggcgcccattttgtgcgggtgcttgcgcgcatagttcttcaccgacagcggtgcgcggcggtcggagttgccttcacgcagaaccgggttcacggcgctgcccttgaccttgtcgtaacgcgccttggcgtctttgtcggcgtcgctggttacggtttccgggtagtccggcaggttgtaaccctgagcttgcagctctttgatcgcggcttgcagctgtggcaccgaagcgctgatgttcggcagcttgatgatattggcttcaggcgtaacggccaggtcgcccagttcagcgaggtggtcggctacggctttgtcgcccagttgctcggggaagcttgccaggatgcgtgctgcaagagagatatcgcgggtttccacggcgatatcggccgaggcggtgtaagcctcgatgatcggcagcagggaataggtggcgagggcaggagcttcgtcggtgaaggtatagatgatcttcgagcgggtgggcatattcggattaactctctcttctttgctaaagcgtgcgcagaaactcgaggggcgccgggtaagcgcgttcgttcaaagtcatccatgaaccgaatgtcgagattcttcgcggtgatgttgggtgcatcagtagagcgtcaagcagtcaggctgcggtaacaacccgaccaatcaggcggaaagtctcgtactagagaggccagccgtcgtgaccctgtggtcagcgggcggcattatacataggtagctggcaatctgccgatggttcatatgcaacgattctcgtccattggtctaaaggtcgcagggcaggatggcgactaaggtcaatgggaatgcttgagtttggcgcttttccctttgctttcaggcttgtacgaaacgacttgtgcgaatgccgggaactgagggtttgcgtgttgatttaactgggttacgctcgaaccaagccagatgttcaatccaaacaatggagttcagcatgggttacaagaagattcaggttccagctgtcggcgacaaaatctccgtcaatgcagaccattctctcaatgttcctgataacccgatcatccccttcatcgaaggtgacggcattggtgtcgacatcagtccggtgatgatcaaggttgtcgatgctgcagttcaaaaggcatacggcggtaagcgcaagatttcctggatggaagtctacgccggggaaaaagccactcaggtttacgatcaggacacctggctgcctcaggaaaccctcgatgcagtcaaggattacgtggtttccatcaaaggcccgctgaccacgccggtcggtggtggcatccgctcgctgaacgtggccctgcgtcagcaactcgacctgtacgtctgcctgcgcccggtgcgctggttcgaaggcgtgccgagcccggtgaaaaagccaggtgacgtcgacatgaccatctttcgcgagaactccgaagacatctatgccggcattgagtggaaggccggttcgccggaagccaccaaggtcatcaagttccttaaagaagaaatgggcgtcaccaagatccgtttcgacgaaaactgcggcatcggcgtcaagccggtttcgctggaaggcaccaagcgcctggcacgcaaggccctgcaatatgtggtcgataacgaccgcgattcgctgaccatcgtgcacaaaggcaacatcatgaagttcaccgaaggtgccttcaaagagtgggcctacgaagtggccgccgaagagttcggcgcgaccctgctcgacggcggcccgtggatgcagttcaaaaacccgaaaaccggcaagaacgttgtggtcaaggacgccatcgccgacgccatgctccagcagatcctgctgcgcccggcggaatacgatgtcatcgcgaccctgaacttgaacggcgactacctttccgacgccctggcggcggaagtgggcggtatcggtattgcgccgggcgccaacctgtccgacaccgtggcgatgttcgaagccacccacggtacggcgccgaaatacgccggcaaggaccaggtcaacccgggttcgttgattctttcggcagaaatgatgctgcgccacatgggctggacggaagcggcggatctgatcatcaagggcaccaacggcgccattggtgccaagaccgtgacttatgacttcgaacgtttgatggaaggagccaagctggtttcgtcgtcgggctttggggatgcgttgatttcgcatatgtaagaaacaccggcaaacgaaaaaaccgcccgactcagatgattgaggagggcggttttttatggctgaaggttctgaggcgtcaactggtcaccgtttgtttttcggtggtgatcgggggcgcttcttgtttggcttcggccgactcaatcttcaccgcatgcaagcctttcgggccctgcacgatgtcgaatttcaccagttgtccggccttgagggttttataccctgccatttcaatggccgagtaatgggcaaagaaatcgatgtctttgccatcctcgtcgcggccttcgcgggcatcggtattgataaagccgaatcccttggcattgttgaaccatttcaccttgccgacagccatgctcaaatccctctgcaacagactccatcgctggagtatcatccaggtcatccgcaatctaatccgttaaaagaattgactccgcggatcttttttacccactgtgggctctattggttgtaacaccgttttcccgatagtcaaggtgaccgggcagtcggagttgaaaacgtggacaaccgcccccaccactgtatttgcacaactgacgaacctttctttcccatgcatgcaatcagccagattcgactaacattcaatcaggatcgcccgcttctccaaaaggatcttccacaggagcacgacgacgattcggcaggcgttgctgttcaggaagcaaagcctgcgttacaggcgccgccaatgtacaaggtggttttgttcaatgatgactacacaccgatggatttcgtcgtcgaagtgctcgaggtgttttttaacctgaatcgcgagctggcgaccaaggtcatgctggccgtccacacagaaggacgggcagtatgtggagtgtttacccgcgacatcgccgagacaaaggccatgcaggtcaaccagtacgccagggaaagccagcatccgctactctgtgaaatcgagaaggacggttaatcgccgaccacttgggtatgaggtgaagctatgttaaaccgcgagctcgaagtcaccctcaatctagccttcaaggaggctcgttcgaaacgtcatgaattcatgaccgtcgaacaccttttgctggccctattggacaatgaggctgccgccaccgttttgcgtgcctgcggcgcaaacctcgacaaactcaagcatgacctgcaggagttcatcgactccaccacgccattgatccccgttcatgacgaagatcgcgaaacccagccaaccctgggcttccagcgtgtactgcaacgtgctgttttccacgtacagagctcgggcaaacgcgaagtaaccggcgccaacgtgctggttgccatcttcagtgagcaagagagtcaggcggtgttcctgctgaaacagcagagcgttgcgcgcatcgatgtcgtcaactacatcgctcacggcatttccaaagtgccggggcatggcgatcactctgaaggtgaacaagatatgcaggacgatgagggcggtgagtcttcttcttcaggcaatcctctggatgcttatgccagcaacctcaacgaactggcgcgccagggtcgcattgatccgctggtcggccgtgaatcggaagtcgagcgtgtcgcgcagattctcgcgcgccgacgcaaaaacaatccgctgctggtcggtgaagcgggcgtgggtaaaaccgcgattgccgaaggcctggccaagcgcattgtcgacaaccaggtgcctgatctgctggccaacagcgttgtctactcgctcgatcttggcgccctgctcgcggggaccaagtatcgcggtgatttcgagaagcgcttcaaggcgctgctcaatgaactgaaaaaacgtccgcaggcgatcctgttcatcgacgagatccacaccattattggtgccggcgctgcgtcgggcggggtcatggacgcttcgaatctgctcaagccactgctgtcgtctggcgacattcgctgcatcggctcgaccacgttccaggaatttcgcggcatcttcgagaaggaccgtgccttggcgcgtcgcttccagaaagtcgatgtcgtcgagccatcggtggaagacaccatcggtattctgcgcggcctgaaagggcgtttcgagcagcaccacaacatcgaatacagcgatgagtcgttgcgcgccgctgctgaactggcgtcgcgttacatcaatgaccggcacatgccggacaaggccatcgacgtgatcgacgaggcgggcgcctaccagcgtctgcaaccggtcgaaaaacgtgtgaagcgcattgaagtgccacaggtcgaagacatcgtcgcgaaaatcgcgcggattccgcccaagcacgtcaccagttccgacaaggaactgctgcgtaacctggaacgtgatctgaagctgacggtgtttggtcaggacgcggcgatcgattcgctgtcgactgcgatcaagctgtcccgtgccggcttgaagtcgcctgacaagccagtcggttcgttcctgttcgcagggcctaccggtgtcggtaaaaccgaggccgcgcggcaattggccaaggcgttggggatcgaactggttcgcttcgacatgtccgagtacatggagcgtcacactgtatcgcgtctgatcggtgcacctccaggctatgtcggtttcgatcagggcggtctgttgaccgaagcgatcaccaagcaaccgcattgcgtattgctgctcgatgaaatcgagaaggcgcatccggaagtcttcaacctgctgttgcaggtgatggatcacggtacgctgaccgacaacaacgggcgcaaggcggacttccgcaacgtgatcgtgatcatgaccaccaacgccggtgccgaaacggcggcgcgtgcttcgatcggtttcacccatcaggaccactcgtctgacgcgatggaagtgatcaagaagagcttcacgccggaattccgtaaccgtctggacaccattatccagtttggtcgcctcagtcatgaggtcatcaaaagtgtggtggacaagttccttaccgagcttcaggcgcagctggaagacaagcgtgtgctgcttgaggtcactgatgccgcgcgtagttggctggcggcgggtggttatgactcggcgatgggtgcgcgtccgatggcacgtctgatccaggacaagatcaagcgtccgttggcggaggagattctgtttggcgagctggccgagcatggcggtgtggttcacatcgacatcaaggatggtgagttgacgtttgacttcgaaactacggctgagatggcctgacggtttgatgttggttgggaaggcgccttcgggcgcctttttgttgtctggtgtttttgtgtgtatatccgttgctgcggtaacggcttcttagggttccgcccttacggcgggtcactttttccagacgcccggaatgccggcccagaaaaaagtaaccaaaaaggcttgctcctacgtgcggcccgctcgctggggctcggggtcccttcgctccgggatcgatccgggcgcagcgcctacggtttgctgcgctgcacctcctctcgctgtgtttggcttcgccaaacggtcgctgcgctcccacgcccggatcaatccctccactcagccttccgacgtcgccttacagatcaagagctgcagccgagctaacgctcatcctgttgagtggtgaagagcatgcggtcggcttttgttcggtgttggatgcacccctcaccccagccctctccccgaggagagggagctgatttgtgggcctttcaaaatctgagttcaactcggtatttcacgtcggcgtaactctgccaaacacctcggtcagtcccctctccctacgggcggtccgacgtttcgggagggctagggtgaggggctcttgatctagctcttgatcttgctttggtttttgatcttttgccccatcggcaggccgagcgaaggtgttcatccgggggttaggcgcgcagcgccgtgcggcgtagccgcatacatcgagaggaggtgcagcgaagcaaaccgtaggcgatgcccccggatggacaccgtagcgagggaacactgagcctcagcgaagtgccgtacgccggggcaaagccttttggttcctttttggcgtttgaaaaagggactcgctgtaagagcgaaaccgccagcggcaacaaccgcagcaacggatatgcccccaaacccaaacccaaacccaaacccaaaccccaaaacgcagatacaaaaacgcccggcataaaccgggcgttctgtattgacttgattaacgagcgcggtaagtgatgcgccctttgctcaagtcatagggcgtcagctcgacgcgcactttgtcaccggtaagaatacgaatgtagttcttgcgcatcttgccggaaatatgcgcggttacgacgtgcccattttccaactccacacgaaacatggtgttgggcagggtgtcgacgacagtgccttccatttcgaagctgtcttctttcgacatgcagtaaagccctcggtatccaatgaatggcccggtgcaactgcgccaggcaaaagcggcgtgcattgtgcccgaaaaatggggtttacgccaaggggtttacggcttgggtttagttgaggatgacccagcgctgattaatcagtaattcgatgggtcgatattgcgtcttgtagttcatctttttgcagttcttgatccagtaaccaaggtacaccgcctcaagcccgaggcgctgtgcctcggcgatttgccagaggatggcaaatcggccaaggctgcggcgctcttcggcgggttcgtagaaggtgtacaccgccgacaaaccgttcggcagcaaatcggtcaccgccacggccagtaaccgtccgtcgagtcggaattcgtaaaagcgcgagaagggcaggtcacggaccagaaaagtcgagaattgatcacggcttggcgggtacatatcgccgtcagcgtggcgttgttcgatgtagcgctggtacagatcgaagtattcttcgctgaactgcggtttggccgggcgcacctgcaaatccgtgttgcgtttgaaaatccgcttctgctgacgattgggtgtgaactgcgccaccggaatgcgcgcaggcacgcacgcattgcagttctggcaatgcgggcggtacagatgatcgccactgcgacgaaagcccatttccgacaggtctgcgtagacatgcacatccatgggctggctcggatcgagaaacagggtcgtggcctgctcctcgggcagataactgcaagagtgaggctgagtggcatagaacttcaaccgcgccaactcggtcatgatcaaccctcgggataagctggtgaattaagtgtaagccacgcgcgcaaaagtcgctcagcaaacccaggtggcacgattgggttgatccaggtgccgggccagataatcagcgaattcgtcgcggggaatggcccgggcgccgagactgtgcagatgatcggttggcatctggcagtcgatcagcacgaactccgaatctttcagatggcgcaccagcgtggcaaaaccatatttcgaagcgttgtcggcacggctgaacatcgattcgccgaagaacaattggcccatggccaagccatagaggccgccgaccaactcgccctcatcccaaacctccaccgaatgggcgaagccgcgccgatgcagttcaatgtaggcatcctgcatcgcttcggtgatccaggtgccatcggcgtaatcccggggcgcagcacaggcgcgtatcaccgcgtcgaagtcctgatcgaaggtcacttgatagcgcgctttgcgcagcaatttaccgagactgcgcgagacatgcagttcgtcgggaaacagcacagtgcgtggatccggtgaccaccagagaatcggctggccctcggaaaaccacggaaagcagccatgccgataagcctgaatcagtcggtcggccgacagatcgccaccggcggcgagcagtccgttggggtcgcgcatggccttttccaatggcggaaaagtcagggaattacgttgtaaccaagtcagcatggcatccaggcttgcagaaggggagggcggtgcgagccgtttggcccgcgataaagtgtgccgttaaatgacaggaatgtcgtccagatacttctcggcatcgagcgcggccatgcagccggcgcccgctgaggtgacagcctgacggtaaacatggtcggcgacatcgccagcggcgaacacccctgggatctcggtagaggtggcgtcgccgtcgctgccgcccttgatcagcaagtagccgtcgcgcatcggcaactgcccttgaaacaggtcggtgttgggtttgtgaccgatagcgatgaacaccccggccaatggcagctcgcaggtgtcgccagtgtggctgtcgcgcaggcgggcgccggtcacgccactggcgtcgccgagcacttcgtcgagattctggttccagtgaaggcgcacgttgccgttggcggctttctcgaacagtttgtcctgaaggattttctccgagcgcagcttgtcgcgacgatgaatcaggtgcacctctttggcgatgttcgacaaatacagtgcttcctcgacagccgtgttgccgccgccgaccactgcgaccacctgattacggtagaaaaagccgtcacaggtcgcgcaggcagagacgcccttgccggcaaaagcctcttccgagggcagtccgaggtattgcgccgaagcgccggtggcaatgatcagtgcgtcgcaggtgtaagtgccgctgtcgccgacaagctcaaacgggcgctgctgcaacttggcggtgtggatgtggtcgtaaacgatctctgtggcaaagcgttcggcgtgcttctgcatgcgctccatcagcaccgggccggtgaggccttcgacgtcgccaggccagttgtcgacctcgacggtggtggtgagttggccaccggcctgcaggccggtgatcaccacgggtttgaggttggcacgggcggcatacacggcagcgctgtaaccggccgggccggagccgaggatgatcaggcgtgaatgcttcgctgcgttcatcaaatacacctcataagcctttgtcacaaaaggtaatgcatgctcaaattgaatcgcggcttctgtgtgcttgactatgctcaatgctggggtttgaagcatggcatcggacgcacaaacccgtacaatgacgggctgttacagaatgttcgcggtgcgctgtgtttataaaagcgccagcacagtgttaaaagtagtctcagttgcgctcgttcacttttttacctgcctggattgggcagttttttatcgtcattcaatagatggacgcgcctcgggcgcaggaaaagaagcgttttgaagaaatccaccgaagcagcaaaaacagtcgttccgctctggcgccaacagttgcactaccggctcaaggaaggtgcattgatcgccattggtgccttgtgcctgttcctgatgatggccttgctgacctacggcaaggacgatccgggctggagccacaacagcaagatcgacgacgtgcagaatttcggcggcccggcgggctcctacagcgccgacatcctgttcatggtgctgggttactttgcgtacatcttcccgttgctgctggcgatcaaggcctaccagatcttccgccagcgccacgaaccgtggcagtggagcggctggctgttctcctggcgcctgatcggtctggtgtttctggtgctgtccggcgcggcgctggcgcatctgcattttcacgctgcgtcgggtctgccggcaggtgctggcggggcgctgggcgaaagcctcggtaatctggcgaagaacgcgctgaacattcagggcagcacgctgctgttcattgccttgttcctgtttggcctgacggtgttcaccgacctgtcctggttcaaggtgatggacattaccggcaagatcactctcgatctgttcgaactgttccagggcgcgctcaatcgctggtggtcggcgcgtaccgaacgcaagcaactggtcgcgcaattgcgtgaagtcgacgatcgtgtgcatgacgtggtcgcgcccacggtcaccgacaaacgtgagcaggccaaagtcaaagaacgcctgatcgaacgtgagcaagccttgagcaagcacatgtctgatcgcgagaaacaagttccgccggtcattgcgccagctccggtcaaagcgcccgagccaagcaaacgcgtacagaaagagaagcaggtgccgctgttcgtcgacagtgccgtagaaggcaccttgccgccgatctcgattcttgatcctgcggaaaagaaacaactcaattactcaccggaatccctggcggcagtcggccatttgctggagatcaagctcaaggagttcggtgtcgaggtcacggtggattcgatccacccgggcccggtgattacccgttacgaaatccagcctgccgccggcgtgaaagtcagccgcatcgccaacctcgccaaagacctcgcgcgttcgctggccgtgaccagtgtgcgggtggtcgaggtgattccgggcaagaccaccgtcggtatcgagattcccaacgaagaccggcagatcgtgcgtttctctgaagtactgtcgacacccgagtacgacaacttcaaatcgccggtcactctggcgctggggcacgacatcggtggcaaaccggtcatcaccgacctggcgaagatgccgcacttgctggtggccggtacgaccggttccggtaagtcggtgggtgtgaacgcgatgatcctgtcgatcctgttcaagtctggcccggaagacgccaagctgatcatgatcgacccgaagatgctggagctgtcgatctacgaaggcattccgcacctgctgtgcccggtcgtgaccgacatgaaggacgctgccaacgccttgcgctggagcgttgccgagatggagcgccgctacaagctgatggcgaagatgggcgtgcgaaatctctctggcttcaacgccaaggtcaaggaggcccaggacgccggcgaaccgttgagcgatccgctgtacaagcgcgaaagcatccacgacgaagcgccgctattgcagaaactgccgaccatcgtcgtggtggtcgacgaattcgccgacatgatgatgatcgtcggcaagaaggttgaagagctgatcgcccgtatcgcccagaaggcccgtgcggccggtattcacttgatccttgcgacccagcggccgtcggtggacgtgatcaccggtctgatcaaggccaacattccgacgcggatggcgttccaggtgtcgagcaagatcgactcgcgaaccatcatcgaccaaggcggcgccgaacaactgctcggccacggtgacatgctctacatgccaccgggcaccagcctgccgatccgcgttcacggtgcgttcgtttccgacgatgaagtccaccgcgtggtggaagcgtggaagctgcgcggcgcgccggaatacaacgatgacatcctcaacggtgtcgaagaagccggcagcggttttgaaggcagcagcggtggcggcgatggcgatgatccggaagccgacgcgctgtacgacgaagccgtacagttcgtcctggaaagccgtcgtgcctctatttccgctgtacagcgcaagctgaagatcggctacaaccgtgccgcacggatgatcgaggccatggaaatggccggcgtcgtcacctcgatgaacaccaacggttcccgtgaagtcctggccccgggcccggttcgcgactgattgcaaaagcaagaggcgggacaatgatgttccgccgctctcccacgagtattcaagaggactcccatgcgtcttatccgcatgctgttgccagtactggcgttgaccacgctcacggcccacgccgatgacaaggacgtggcgcgcctgacccaattgctggaaacatccaagaccctgagcgcgaatttttcgcagctgaccctcgacggcagcggcacgcagctgcaggaaaccactggcgacatgaccctgcagcgtccgggcctgttctactggcacaccaatgcgccggccgagcagaccatggtttccgacggcaagaaagtcactctgtgggacccggatctggaacaggcgaccatcaagaaactcgacgagcgtctgacccagaccccggcactgctgttgtccggcgatgtttcgaagatcagccagagcttcgacatcagcgcgaaagaggcgggcggcgtgatcgacttcaccctcaagccgaagaccaaggacaccctgttcgacaacctgcgtctgtcgttccgtaacggtctgcttaacgatatgcaactgatcgacagcgtcggccagcgcaccaacatcctgtttaccggggtcaaggccaacgagccagtaccggcatcgaagttcaagttcgacatccccaagggtgccgacgtgatccaggaataaacccaaaaccttgtgggagtgagcctgctcgcgattcgatttgtcagtcacatcttcatcgtctgacccaccgctatcgcgagcaggctcactcctacagggtcaatgatcggcaaaatagaggtttcaacgctacgtgatggatctgtttcgcagtgcaccgattgcccagccactggccgcgcgtttgcgtgcgaccaatctggatgagtacgtcggtcaggagcacgtgctcgctcgcggcaagcctctgcgggaggcgctggagcagggtgccctgcattcgatgatcttctggggcccgccgggcgtgggtaaaaccactttggcgcggttgctcgcggaagtctccgacgcgcacttcgaaacggtctcggcagtgctcgccggggtcaaggagatccgtcaggccgttgaaatcgccaagcagcaggccggccagtacggcaagcgcacgattttgttcgtcgatgaagtgcaccgtttcaacaagtcgcagcaggatgcttttctgccgtacgttgaggacggcacgctgatcttcattggcgccaccaccgaaaacccttcgttcgaactcaacaacgccttgttgtcgcgcgcccgcgtctacgtgctgaaaagcctcgacgaagcggcgctgcgcaaactggtacagcgcgcgctcaccgaagagcgcggcctgggcaagcgcaatttgacgttgaacgacgaaggcttccagatgctgctgtccgccgccgatggcgatggccggcgcctgctcaatctgctggaaaacgcttccgatctggccgaagacaacagcgagatcggcacggagttgttgcaaagcctgctcggcgatacgcgtcgacgcttcgacaagggcggtgaagctttttacgaccagatctcggcgctgcacaaatcggtgcgcggttccaaccccgacggcgcgttgtactggttcgcgcgaatgatcgacggcggttgcgatccgctgtacctggcccggcgcgtggtgcgcatggccagcgaagacatcggcaacgccgacccgcgcgccctcagcctgtgccttgcggcgtgggaagtgcaggagcgcctcggcagtccggaaggcgagttggcggtggcgcaagccattacctatctggcctgcgcgccgaaaagcaacgcggtgtacatgggcttcaaaactgccctgcgtgccgccgctgaaaacggctcgcttgaggtgccactgcacttgcgcaacgcaccgaccaaactgatgaaacaattgggctacggtgacgaataccgctacgcccacgatgaaccggacgcttacgccgccggcgaagactatttcccggaagaactcgagccgattccgttctaccaaccggtgccgcgcggcctggaattgaagatcggcgagaagctcaaccacctcgcccaactcgaccgtttaagccctcggcagcggagaaaatagtgcttccattgattgttgcggtctccgtcggcggtgtcgccggcaccttgttgcgcttcgccaccggcaattgggtcaacgccaattggccgcggcacttctataccgcgacgctggccgttaatatcgtgggctgtctgttgattggcgtgttgtacggcctgtttttgatacgcccggaagtgccgatcgaggtgcgcgccgggttgatggttggcttcctcggggggctgacgactttttcatccttttcactggatacggtgcgcctgctggaaagcgggcaagtgccgctggccctgggctatgcggcactcagcgtattcggcgggctgctcgcgacgtgggctggcctgtctttgaccaaactttgataacgagaaaccgacatgctcgattccaaactgttacgtagcaaccttcaggacgtagcggaccgcctggcttcccgtggctttgccctggataccgcgcgcatcgaagcgctggaagaacagcgcaagaccgtccagacccgcaccgaagcactgcaggctgagcgtaacgcgcgttccaaatccatcggtcaggccaagcagcgcggtgaagacatcgcgccgttgatggcggacgtcgagcgcatggcgggcgaactgagtgccggtaaagtcgaactggacgcgatccagaccgaactggactcgatcctgctcggtatccccaacctgccacacgaatccgtgccggtcggcaaagacgaagacgacaacgtcgaagtgcgccgctggggcacgccgactgcattcgatttcgaagtgaaagaccacgtggcgctgggcgagaagttcggctggctggactttgaaaccgccgccaaactgtccggcgcgcgtttcgccctgttgcgtggcccgatcgcgcgtctgcatcgcgcactggcacaattcatgatcaacctgcacgtcaatgagcacggctacgaagaggcgtacacgccttatctggttcaggccccggcgctgcaaggcaccggtcaactgccgaagttcgaagaagacctgttcaagatcgcccgcgaaggcgaagccgatctgtacttgatcccgaccgccgaagtgtcgctgaccaacatcgtcgccggtgaaatcgtcgattcgaaactgctgccgatcaagttcgtcgcccacaccccgtgcttccgcagtgaagccggcgcatcgggtcgcgacacccgcggcatgatccgtcagcaccagttcgacaaagtcgagatggtccagatcgttgagccttcgacctcgatggaagcgctggaaggcctgaccgccaacgccgaaaaggtcctgcaactgctcggtctgccttaccgcaccctggcactgtgcaccggtgacatgggcttcagcgcggtcaagacttacgacctcgaagtgtggatcccgagccaggacaagtaccgcgaaatttcctcgtgctcgaactgcggcgacttccaggcccgccgcatgcaggcgcgtttccgcaatccggaaaccggcaagcctgaactggtacacaccttgaacggttccggtctggccgtaggccgtacgctggttgccgtgctggaaaactaccagcaggccgacggttcgattcgcgtgccggacgtactgaagccgtacatgggtggccttgaggtcatcggctaaatgaaatatctgccgctgtttcacaacctgcgcggcagtcgtgtgttggtcgtcggtgggggggaaattgccttgcgcaaatcccgcctgctggccgatgccggtgcgctgctgcgggtggtcgcacctgaaatcgaaacgcaactgcgtgagctggttaccgcttctggcggtgaatgcctgttgcgcggttacgtcgaggcggatctggacggttgcgggctgatcattgccgccaccgacgatgagacgctgaacgcccaagtctccaccgatgcgcacaagcgctgcgtgccggtcaacgtggtcgatgcaccggccttgtgcagcgtgatcttcccggcgatcgtcgatcgctcgccgctgatcattgccgtgtccagcggcggcgatgcgccggtgctggcgcgtttgatccgggccaagatcgaaacctggattccatcgacttacggtcagttggccggactcgccgcgcgttttcgcaatcaggtgaaaagcctgtttccggatgtgcagcagcgtcgtggattctgggaagacgtgtttcaggggccgattgccgatcgccaactggccgggcagggcgctgaagccgagcgtttgctgcaagccaagatcgatggtgaagccatggtcaccaccggcgaggtgtatctggtcggggcagggccgggcgatccggatctgctgaccttcaaggctctgcgcctgatgcagcaagccgacgtggtgctttacgaccgcttggtcgcgccggcgattcttgagctgtgccgtcgtgatgccgagcgggtctacgtcggcaagcgtcgcgccgatcacgccgtgccgcaggatcagatcaaccagcagctggtcgacctggccaaggccggcaaacgtgtggtgcggttgaaaggtggtgatccgttcatcttcggccgtggtggcgaagagatcgaagaactggcgtcccacggcattccgttccaggtcgtgccgggtattacagcggccagcggttgcgcggcgtatgccgggataccgctgacccatcgtgattacgcgcagtcggtgcgctttgtcaccgggcatttgaaggacggttccaccgatctgccttggtccgatctcgtcgcgccggcgcagacattggtgttctacatgggcctggtgggtttgccagtgatctgcgaacaactgatcaagcatggtcgttcggcggataccccggcggcgttgatccagcaggggaccacggtcaatcagcgggtttttaccggcacgctggctgatctgccgcgactggtggcggagcatgaagtgcatgcgccgacattggtgatcgtgggagaagtggtgcaactgcgcgagaagctggcgtggttcgaaggggctcaggcgcaggtctgagtcagatcaaaagatcgcagccttcggcagctcctacatgagaatgcgttccctgtaggagctgccgaaggctgcgatcttttgctttttgctattaacccttcaaccaaacccctttcccagccagccgcgcccgatcatgcgccaaggtgaaatcctgcgccggccccttcggcacaacccccgttgggttgatggtcttgtggctgccgtagtagtggttcttgatgtgctggaaatccactgtctcggcaatccccggcagctgatacacctcacgcagccagtttgacagattcgggtaatcggcaatccgccgcaggttgcacttgaagtgcccgtgatacaccgcatcaaaccggatgatcgtagtgaacagacgcacatccgcttcggtcaggtattccccgctcagataacggttggcgcctaaaacgcgctccagatgatcaagttcggcaaacacctcatcgaacgcttcttcataagcctcttgcgacgtagcgaatccggcgcgatacacaccgttgttcaccgccggatagatccgctcgttcaacgcatcgatttcaccgcgcaacggcgccgggtagaagtccagatcgttgccagtcaagccatcgaacgcgctgttgaacatgcggatgatctcggctgactcattgctgacaatacgcttgagtttcttgtcccacagcactggcacggtaacgcgtccggtgtaatcggcagtgtcggcggtatagcgctgatgcatgaattcaaaaccatcgagcttgtcgccggtcgagccgagtgcttcgtcgaaggtccagccgttctccagcatcagccaactgaccaccgacacgtcgatcagactttccagacctttgagcttgcgcaggatcagcgtgcgatgcgcccacgggcaggcgagggaaacgtagaggtgatagcgcccggcttcggcggcaaagccaccttcaccgctcgggccgggttgaccgtctgcggtcacccagttgcggcgcttggcctgttcgcgctggaacgcgccgtccttgctgctttcgtaccacttgtcctgccagcggccatcgacgagtaaacccatgatcaagactccgtaaaccaataatcgttggagtcgagtctattccgatgagttcgaacaaaaagcgcaaagatcgggcgcgaatgatcggttaaatcgatttgtcccgcgcagcccagtattgctcggcagtttcgaaggcttgctcgcgcggctggccaaggccacgcagggccagcgccatcgtcgagatcagcgccatttgcgggtagctgtcgaccacttcaccgcgccacacggctttcagatgttcgacgtccaaagttgccggtttgacgtggcgttgtgccgacatctgtggccattcctcatcccagctctcgccgcccgtggtgccgtagagatggctgtcagcgtccgggttgatctcgatttcgccgccgtcacccttgaccacaatcgccgtgtcgcccagcagcccgctggcatcgcgatgcactgcctgatagccaggatggaaaatactttgcagcccgcaacgtgcgcccagcgggttgagaatccgcgccagcgaatgaatcggcgagcgcaggcccaaggtgttgcgcaggtcgatcatgttctgcagttgtggcgcccagtccaccagcggtatgaacgccagaccaccattatccagcgccgcgccgacttgttgccaggtgcggcacaacgggatgttcagctcgccgagcagttgctcgctgtacagacgcccggcggtgtgcgcgccgccgccatgcatgaaaatgcgcatgccgttctgcgccagacacttggcggccagcaggtaccacggcagatggcgcttcttgccggcataggttggccagtccaggtcgacattcaatgcaggcgcctgcaaacgcgcgcgcagcgcttcggtgaacccagccatttcctcggcgctttcttccttgtgccgcagcaacatgagaaaggcgccgagctgggtgtcttcgaccttgtcgtcgaggaccatgcccatggcttcgcgagcttcctcgcgggtcaaatcgcgggcgccgcgcttacccttgccgaggatgcgcacgaattgagcgaatgggtgttcggcaggcgtttcgagggtcagcgcgggaaagtcggtcataagcaattcgtcggtttgggcaggcccgccagtttcgcggcgagtttggcaggggtgcctttgaacagtcggttcaggtgcaggctgttgcctttgtccgggccgagcttcagtgctgtgtacttgatcagcggtcgcgtggccggggacagctcgaattctgcataaaagctgcgcagcagttcgaggacttcccagtgctcaggggtcaactcgatctcttcagcggcggcgagggcgctggcgacatcagccgaccagtcactcaggtcgacgagaaagccgtccttgtccagttcgatggcgcgggcgccgacggtcatcgaattcatagccagctgttgaccttgtcgtggtggatcgacagttcgacgaaggcaggataatcgatcacttcggcccattccggaacttcgatggcgcgagcctgagcatcttcggcaaggacgaataatttgatttggcgggtttgcaatgcgctgaacggcgcggtgcccggttgcagcgcataaaccgcatcgccggacagcagtaacgcatccgcactgccgatgatgcgcaggcaactgttcaagcgatcgtcgccgaacggggaatgagacaacacgtgcaaagtcgacatcagagggtgatcacctggtcgtaacggtcaataagggcggtgatgtgctcggcggccagtggctgcgcttcgtccagcgacaacttgtcgaggcctcgggcgctggcgctgtcggcgcagtagaacaactcttctacaccaaacatcggcagcgcttgaaggttggcgctgaggtctttctgttgcaaagccttggcgttttgcccggcagccagttgcaacacaccgtcatcgagaaacagcaggccgatcggcagatcgaaggcgccaccggcgaggacgatgtccagcgcttcgcgggcagcggggccggaccatggcgattggcgactaatgagcagcagggatttggccatgttacgcacctccgaagcagatcagacggtcggcgtcttgcaccgcgtcgtgcaactggcccagaccggacaattcccacggtgcgctgacggagaccgcttcacgctgatagcgcctggcttcttcattgttcagcacgccgcgacgcagggcggcggcgatacacactacgccgtcgagcttctgctcagtgatgaatgcgcgccactgcttgggcaggtcgagttcatcctgcggcgtgaccaccgcatcagaggcgttgtagacgccgtcctgatagaagaacagccggacaatttcatgcccaccggccagcgtagcctgcgcgaacagcagggcgcggcgcgaggagggcgcgtgggcggcggaaaacagcgcgatggcaaacttcatgacggactcgatcagcaaaactgcggccatgataaagcattgcagaccgcaaaggatcgcagcgcttacagggaaacacgatctctgtaggagctgcggcacgctgcgatctgttgattttgattttgagaaacaagatcaaaagatcgcagcctcgtttcactcgacagctcctacagggagtacgggtcgggcgttggttagcggggcatatagcccagttgccagcgccgcgggattttcagagagagcagcccgatcgtcgcggccagcaaaccgctgacaaacatcgctttgagtcccagatggtgttccagcaccgcccccagaatcgcgccgacaaacatcccgctccaaggcaccagttgcacgcgccagccgctgcgccgttcgccgagcatccagcggcccagtcctcgcccgaatcgcgacaatgcacccgtgacataggtaagtccgaccggtaaaccattcacttcttcgactgaggcattgagcatgcccatcgcaatgatcgccgccatcagcgccggcagttgtgtgtcgaatggccagaccgccgccgcacaaagcagggcggcgatacacagcagcagcggtaacgcccggcgtccgccgaaacgtgcgacgacaacccccaaggcattcccgacaataaatgttgcgacgaggatcaacaggcgcacagtcaacccgacgtcgccatcactgatcgccacggcaagtcgggtggtgttgccgctcatgaacgagacgaagtcaccgctggccataaagccaatggcgtcggtcattccggccagcaccgaaaggctggccaccagcgccagaccaatccgcccgcgccacttttgtgtgtgcagatggccggggctggcgcggtgagtcgaggcggatggcagcatgagtgcggtgtcctggggcgacagttacggttctatgccatatagatcgcaatattccagccaatccatcccggccatttccgccacctcacggtggacttccagccgctgcgcctgatactcctcaggcgaatcagcggtcagttgcaaggtcaactcccaggcgaacagcccaagactttccgcctcggcttcaaatgcttcgtgcaggcgctcttcacgatactgcgcctgagtttcgcctttggcctgggccagcaacgggttgagatgatcgagggtttcgcgcagttcgggacgcgcgtcgagaaatacttgcagggcatgttcatgtcgctggtcggtaggcgccatgtggtttccttatgaggctgatgagcttgggttgccgcagcggcctgcgtgtgtcgcgctataaatgcagtaaagcagaacgatttctgctgctgcaatgatacagtccgcttttttctgaatgagcgaatgcaatgcgaattctgatggtagcgctggcggcgacgatgctggccggttgcgcgggttcggcgatgaacgatgctcgcactcaagccccttacaaggtactgacttcggacaaagccgagaaagtcgtggcccagtgcgtgcaattcggctggcaggatgaggcggtgttcggtgtcgatgcggcggcttatctggaaccgcgcaagctcggcgggacgacggtctacacgcgttcggcggagtcgtttgtggacgtgatcaccgaggcctcgggcacgacgttgaattactacgcgcagaaggatgattttgttgccaagcgccggttggcggcgttggcgacctgcctctgatcatgtgttgacgcagctgtcggcatcgtcggaacgccgcccggagcaggctcactcctacagtggaatgcattccagatgtgggagcgagcctgctcgcgaaggggccgcaacattcaaccgatcaatcgcttctggaagaaatgccgcttatgccccagtggataatccagaatctctccgcattcgctgaatccaagcttcttgtaaaactccggtgcctggaaggagaaggtgtcgagccagatgccaacgcagtctttttcccgtgccagatcttctgccctctgcatcaactgcgagccgatacccttgccgcgaccttgctccggcacggccagtaactcaatgaacagccaacgatagaacgtgtgggcatacaaaccacctagaatcgcgtcgtgttcatcacgtactaacagagcgatcggctcgaaggtcgacggtccggctttggcaacgttgtgcgcacgcagcggcgcgaggatggctgtgcgttcttcttcggtcgggttttgtgacagctcgatacgcaagttcatgcatgacttccttgttgtttgagttcgcagcctatcctgccgcgcggtcatcttccaagccccgtttcaaccctttggaactgccgctcacgcgccggggtctagctgttacagcgtcattccagcacgcggttgatgaggacatcccatgaacattttcgaagcccttcgcgaaagccatgaccgccagcgtacgtacgccaagacgttgatcgaaaccagcggtgacacgcctgagcgggtcgaagcctacaaacagctcaaggcagaactccaggcccatgaaaccgccgaagagcgccatttctacatcccgttgatggagcttgacgagggggtcgacctgagccgccatgccatcgccgaacaccatgaaatggacgagatgatggaagaactcgacgagaccgagatgtccagtccggcgtggttggtaactgccaagaagctgtcggacaaggttcatcatcatttgaaagaagaagagcagaaattcttccagatggccggcaaattactcaacgaaaaacagaaagtacagctcgccggtcagtacgaaaaggagttcaaggcacagctgccgtgagtactgaatggcagcttttgcagcattgacgtgtaatcctttggcgtcatttagggtgggttttatcgcaatggctgtatatacatccagtgtttgcggtgttttcaggttttaacgccgctaactgcgacaaaaccgccgatggacaaaaaatccgtctccgttagcttgaaggcctctcctcggaaaggagagttcttaaatcaacggagtgaaaaacatgaatcaaccacaaacccaactgcgacacggtcgtgtgatttcccctgcaagccgcggtgcggtagcgatcgagcaaggattgctcggcgcctggcaggtcaatgaaatggaaggcgggaaaaatttcccggcgctggcagcgggcccgttcccggccccttaccagaccgactcggacagtgtcacgccaccggctgatggctacatactcagcggcggcaagagcgatgcccgcgattgcgtgaacttcaccaatgacgaaatgagcaagaagctctcccgtccattcacctggccgctgctcaatgtcaccccggggcaaaccctcgaaatcaaatgggaatacaccgcgccgcacaccacccgtggttaccgctggctgatcaccaaggatggctgggacccgaaacaacgcatcactcgtgcgcaactggaagcccaaccgttcttcgaggacttctacactcaggtgccttattacagctacccgaatgagttgaaggccaaggtcaatcatgcggtgaaactaccggccaacaagacgggccatcatgtgatcgtactgatgtggatcgttgccaacaccggcaacgccttctatcaggccttcgacgtcgacttcaagtaacggcgctgcgtcgtcaaacccacacgttctgaaggattagaacatgtcaaaaatcgatttctctttagtgcaaagcgcggtgagcgatgccgcctcgctgatgccgagcattgccggtaaaaagatccttatgggcttctggcacaactggccggcgggcccgagcgacggttatcgccagggtcgcttcgccagcctttcgctggaggaggtgcccaaggaatacaacgtcgttgcggtcgctttcatgaagggcagcgggattccgaccttcaagccgttcaacgtttccgatgccgagttccgccgtcaggtcggcgtactcaacagccaagggcgggccgtattgatttccctcggcggtgccgatgcgcacatcgagttgcgcagcggtcaggaacaaccgttggccaatgaaatcatccgtctggtggaaacctacggcttcgacggactggacatcgatcttgaacagagcgcgattgacttcgctgccaacaagaccgtcctgccggccgcgctgaaactggtcaaggatcactacgcaggccagggcaagcacttcatcatcagcatggccccggagtttccgtacctgaccagcaccggtaaatacgtgagctacctgcaggcactggaaggctactacgactttgtcgccccacagttctacaaccagggtggcgacggggtctgggtgccggaggccaacaatggtgcgggtgcgtggattgcgcagaacaacgatgcgctgaaggaggatttcctctattacctgaccgaaagtctggtgaccggcacgcgcggcttcacgcggatcccggcggacaagttcgtcatcggcctgccagccaacaatgatgcggcggctaccggttatgtgatcgataaaaccgtggtcgggaatgtcctcaagcgtctggcgatcaaggggctgccgatcaaaggcttgatgacctggtcggtgaattgggacaacggcaccagcaaggatggcgtgccgtacaactgggagttcagccggcgttatgggccgctgattcagggggggcgttccgttgggcaggatgtcgatgacatgcaatcgcacatcgcccggtagttgcaaataaagaagcccggtagcgctgccgggctttttttgttcgcgcaattattcgaccatggcggcttactcaggaaacaggatcaagcgtcatgtccaacacagccgagcgggtcaacatcgtcgacactcaggtgttgtcccatgactggtatctgctgaagaaaatcaccttcgactatcaccgcaacaatggcgagtggcagcgtcagacccgtgaggtctacgaccgtggtaacggtgcagcgattttgttgttcaaccgcgagcagcgcacggtggtgttgacccggcagtttcgcttgccggtgttcgtcaatggtcatgatggtttgctgatcgaggtggcggcggggttgctcgaaggcgcggcaccggagcaacggattcgcgacgaagccgaggaagagaccggttatcgcgtacatgatgtgaagaaggtattcgaggcttacatgagccccggctcggtgaccgagaagctgcactttttcattgccgaatacgacgccgcatcgaaggtcagcgacggtggtggtctggaagaggagaccgaagaactggaagtgctggagtggcgattcgatgacgcgctggcagcgtttcagcgcggtgagatctgcgacgccaagaccatcatgctgttgcagtatgcggcgatgaataacttgtttgactgataaatcaaaagatcgcagccttcggcagctcctacaggaaaacgcattccagggtaggagctgccgaaggctgcgatctgacggctaaaacaaatccccggttttgccaatctgcgaccagtcgccaccttcaagggtcagcaagcgctctttcgcctccaggcccccggcaaatccggtcagtttccctgacgcgccgatcacccgatgacacggcgcgacaatggaaatcgggttgcgtccgttcgctgcgcccactgcccgcacggcgctgggattgccgatctgttcggcaatctggctgtaggtccgcgtctcgccaaatggaatggtcagcagcgccgcccagacctttttctgaaaatcggtgccagcgaaatccagttccagatcaaaacagtcacgcgtcctggaaaaatattcttcaagttgtcgagccgttcgaatcaggatcggattgtcgtgtgcctcgctcatcggcccgaggcgcacgcggttcggtttgtcgttttcccagaggatggccgccagtcgtgaaccgttcgcgaccagcttcagctcgccgacgggcgagggcagggtgatgaacgtataggacatgacggcagactccggatcaggacggcaacagcgcccagcatactgcctgagcggggaggcgcaatacgcaaagccgaccatactgcttggtgctcttgcagcgttccccgctctgttttgcacagaccctgaaaacaaaaaaagagatcgactcatgaagtacgaacctttggccagatcgctgattgcgacctcactggcactcagctgtctcatggctcacgcggcgtcagtcgcaccggttgctgccgaaaacggcatggtggttaccgcgcagcatctggccactcacgtgggcgtcgacgtattgaaaagtggcggcaatgccgtcgatgcggcggtcgctgtgggttacgcgctggcggtggtgtatcccgcagccggtaacctcggcggtggcggcttcatgaccattcaattggcggacgggcgcaagaccttcctcgatttccgcgaaaaggccccgttggcggcgacggccaatatgtacctcgacaaggaaggcaacgtcattcccgacctgagcacccgtggccacttggccgtcggcgtaccggggaccgtgtccggcatggaactggcgctgagcaagtacggcaccaagccgcgcaaggagatgattgccccggcgatcaaactggctgaagacggtttcgcgctggagcagggcgacgttgagttgctggaatacgccaccgatgtgttcaaaaaggacatgcgcgattccggttcgattttcctgcacaacggcgagccgatgcaggtcggacagaaactggtgcaaaaggatctgggtaaaaccctgcggaccatttccgaaaaaggcgccgatggcttctataaaggctgggtcgccgatgccatcgtcacttccagccaggccaacaaaggcatcatcactcaggccgacctcgacaaatacaagacccgcgaactggccccggtggagtgcgattaccgtggttaccacgtggtctccgcgccaccgccaagctccggtggtgtggtgatctgtcagatcatgaacatcctcgagggctatccgatgaaggatctgggtttccattcggcccagggcatgcattatcagatcgaagcgatgcgccacgcatacgtggatcgcaacagctacctcggcgatccggatttcgtgaaaaatcccatcgagcacctgctcgacaagaactacgccaccaaactgcgcgacgccatccagccacagaaggccggggtctcggctgagctgaaacccggcgtcgcaccgcatgaaggcagcaacaccacgcattattcgatcgtcgacaagtggggcaatgcggtctcggtcacctacaccctcaatgactggttcggcgccggtgtgatggccagtaaaaccggggtgatcctcaatgacgagatggacgacttcacctccaaggtcggcgtgccgaacatgtacggcctggtgcagggcgaagccaacgccatcgctccgggcaaggcgccgctgtcatcgatgagcccgaccatcgtcaccaaggacggcaaagtggtgatggtggtgggcacgccgggtggtagccgcattattacggcgactttgctgaccatgctcaacgtcatcgactacggcatgggccttcaggaagcggtcgatgcgccacgcttccaccagcagtggatgccggaagaaaccaacctcgaggacttcgccgccagccccgatacgcgcaagattctcgagagctggggccacaagttcgccggcccgcaggacgccaaccacatcgccgcgattctggtgggggcaccttcgctgggcggtaagcccgttggcaaaaaccgtttctacggcgccaatgatccgcgccgcaacactggcttgtcactgggttactgaggggcgtaaaaaaggggcgggctcacgtccgcccctgtctcaaggactgatcaaggaaggctcatcatgaccaccgcattactgatcatcgacgtccagcgcgccctctgctcgggcgaatatcagtgccatgacattcaccgggtgatcgacaccatcaacggtctcagcatccgcgcccgccaggcaggtgtgccagtggtgctgattcagcacgaagagaaggacagccccttggcccatggtgccgaaggctggcaattggccgaagggcttgagacatcgcccaaagacctgcacgtacgcaaaaccaccccggactcgttctaccagactgacttgcgcaaactgctgccgagcgaagattttgaaaaactggtcatctgtggtctgcaaactgattactgcgtcaacgccaccgtgcgtcaggcccatcaactgggttatgacgtggtgctcgttgcggacgcccattccaccgtcgacaacggcaacatgagcgccgaagacatcatcgccgaacacaacaaggatctggcgcacctgaccggctccgtggcgcgtatcgacgtcaaacccgcagccgacatcacgttctgacaacccacacaaaacctgtaggagtgagcctgctcgcgatagcagtgtgtcagttggcgcagcatcgtctgactggacgctatcgcgagcaggctcactcctacagtgattgcgaaaccctgattgccatgtacatcagggatttccgctggcggcactggcatactgcccgccgtccgaagaatggaatctctcgatgttcgctatttccctgcgtcatgccttgctgctgtcgtcccttgcgtttgcctctattacccacgccagcagtttcgactgcaccagcgccgccagcaaaaccgaaaaagccatttgtgccgattcgtacctctcgaatcttgaccagaaactgggttcgctttggcgttccactctggcagaggttgccgatccgaaggcgcttaaaacggatcagcgaggatggttgaagcaacgtaatcaatgtgaagaccgggttccctgtttgcgccggcagtatttgatgcgtctcacggcacttgaatacatggtcaaaccgttttcctgggacgccacctggcagctcattccctggggagtttcggaaggggcagaaatcaccaccaggcgccaggatgcttctctcatcgcctttgatatttcagccgcaaacggctcccactcgggggaactggaaggcattgcaacgataaaggggacgcaggcccgatacgagcagggagaatgtgtcttgaccttcaaggctctcaacggcctgatcgatgtagtacaggatggcgctgattccgattgcggcgccggcatgggcgtttactacggtggacggtatgtgccatcgaagcaggcagtcttggtcgactatgatttgctcacgctgggtgtggcacaaacccagcgggaaaacgaaatcctgcacacgctgctcaaggacgactatcagacgctactgcaaaactgcggcttgaagatggacggtgagtcctctgaagaggttccggacagtgaggtcagcaactattgggttcgaggattgccgtcgagcaacgcggcgattgtcatgcgtgcaccgaatgagcagttctggatcatagtcctgataccccagtccgtgggtaaaacccttgcgcgttactacaccaatgttgcgcaatggaaagggcgtatgcccgacgtcctgcaagcctggtatgcaagtaaaggcggggaaggccatatgcctgtggatttcatgccctgacccgcatcaatcctgctggcgtccgaggggttgtgaaaccacagcccttcaagtcgcaaacaaaaccccacgaatctcgccgactcgcggcgctacgaccacgccctcaagcaccatacgcgtaatcgtctgcgccgccatttgataatcctcatcctgcggcacttcgcgcccggtgatccggcccatttgccagccaatattggtgtacgtccgcgtcgccgaccagatgaacagcatcaaatgctccgggtccaccggcgcgagcaaaccgcgttcgatccagctgcgcaggcattcaacattgcgccgcgcttcggtccgcaacagatcgcggcactcgtcgggcaactgtcgaccgccaagcagtaactcgccactgaacaccttggcaatcgccggatgttcgcgggctataccaatccgcgcggcgacgtaggcgcgcagccccgtcagcggatcatcgctttcacgcagcactgccgaggcctccagcagcggttcgacaaaacccagcagcactttgctgtagaggttttccttggtctggaagtaataatacagattggccttgggcaccccggcacgcgccgcgatatcgcgggtctgggtggcgtcgaagccgttggcggcaaactcctcgctggcggcggcgaggatcaactgctcgttgcggacgcggatggcactcatggacacacagattggctggacggcatgaaaaggttctggcgatttcggattcgcaatatacaaaactatatagcggtgaggccagcacactcgacagacagcgctatgatgattcgatcattgattggaaacggagcgaggccatgtcccttcatgctttgcgggccgacgcgacacatctggatgcggtggcggcgttgttcgacgcttatcgaagcttttatcagcagccgtcgaaccttgagcaatcgcgagccttcatcgcagaacgcatggctgccagcgaatcggcgatttttctcattcaggatgaaaacggtgaagcgctgggtttcgtgcagctgtatccgacattttcgtcaatcgatgcccaccgcacctggctgctcagcgacctgttcactgcacctgccgcccgtgggcgcggcgttggccgactgctgatgaacacggcgcgggattttgccttggcgaccggcgccaagggattggtgctggaaaccgccacggataacttcacggcgcaaggcttgtacgaatccctcggctacgtacgcgacagtggttactacacctatatgctcgacttgcggcagggctgagcaatttttttgccgattttgccatttcaggctttcgctggaaggccgctctctctagaatccgcccggccttcgcaatgaaggctcaatgccatcatttggtcgtgtacacatagggacggacatcatgcaattcgggaaaattctggcgctggggctggtacttgcgctgggcggctgtgccagtttcaccaaagacgaagtggcgccggtgaccatgccgtcgatggccagctacaccaacaagccaaacgtctacgtcgatttcgatttctatcagggcgagccgaaaagtggttccgccgtggaagtgccgcaggcacgtgatcaactgaaaccacagctgcaaaaaattcttaccgattcgggtctgttcggccgtgtcactctggacgagttccagaagcagccgggcgactacagcctgcgtctgaaaatgtacaaccatccgccgaatgcaggttccatggtgctggccttcatcagcggcttcagcatgatggtgatcccggcgtacggcactgatcagtacaccttgagcctggaaggtatggatggccaaggtcaggccctgaccactgcgagcaaccacgatgcggtcggtacctggatcggcatctggtttatcccgctgatggccaacacgactaaagacgcggtaaatgacacctttacccgtcaggtcaacgcgttgctcaagcaaatggttgataacaaaaacctgaagtactcggcactcgaaaccggtatcccacgggtttgaagcgaaaaaagagccgcaatcgcggctctttttttgcccttatttcagggcctgaatgaactgtggatcgctgtacagttccttcagcaaatcgcgcaccatcgggttgtaagcgttgaccgcgttcgggatcgcaatgaaaccgaagaagctgctgctccactggctgctgacatctttggtggcgtcgtacaccacattgttgccgttgagcagtgtaaagcgagcggccagtttgccgtcgccggtgcccatgccggcggacagttcgttcttcaccaccagtactttcaactgacgctgcgcctgtggatcgagcagaccggcctttctcagttcttcggtgatcgcgtcctgaatgtgcgccgggatgctgccggacggcgagcgcaccgggttggcgcggaccaccagcgaaccttcaccggattcggcggtgacctgaggattgctgatcgcgtgcagcggcggggtttgcttgagcttctggacgttctcaaagcttggctcgtagcgggtcatggtcatgccacagccttgcagtagcagggccagcatcgggatcaacaacagcgacttcttcacggcagttccttgcgtgggaatagaggagggcgcgaattatgggcagagtgccatcattgagcaacctcgttcgcttgcacgttgagcaagtgctcgatctgtgccagttcccaagtactgagcaaacttaccgggtcggtgccaaaacgctgccagtgttctagcgagccttcttgtccatcgccgctgcgggcatattcacagtgatgtaatcgccccccggcgaaatccagcagcaggcgccagccgtcgatatcgactgtgaccattgcggtctcgacgggtgcttcgcagactttgaacgcgagcactccgagtgccgcttcacgcaaacgctggcacacctcgcgggacgtcagaaatgcagacatgtcgaactcaatgaccagaggagcgcgccagcataaagcccgagccgacaagtgtcagcgttcactggcccgatcctgaacaattccgtaacatccgcaaccctcttttccccgaacacctgcggccgtactcgtcggccgctcagtcaggtaagccatgaaaccgaaacgtctgcgcgccgatgtcctggccggactcaccacctcgtttgccctgttgcccgaatgcattgcgttcgcgctggtggcgcacctcaatccgctgatgggcctgtacggcgctttcatcctttgcacactgaccgcgttgttcggcggccggccggggatggtctccggtgccgcaggttcgatggccgtggtcattgtcgcgctggtggtgcaacagggcgtgcagtatctgctggcgacggtgctgctcggcggtctgatcatgatggcgttcgggctgctgcgcctgggcaaactggtgcgcatggtgccgcacccggtgatgctcggcttcgtcaatggcctggcgatcatcattgcgctggcgcaactggagcatttcaagagcggtgaggactggctcagcggcacgccgttgtacctgatgaccggtctggtggcgctgaccatggccatcgtctacattctgccgcgcctgaccaaagcggtgccgccggcactggtggcgatccttggcgttggcttgctggtctacctgttcggcctgccgacccgcaccctcggcgacatggcgcacattgccggcggcctgccgacgttcgcgctgccggacattccgtggaacctggacaccctgcgcatcatcgccccgtacgcgattctgatggcgctggtcggtctgctggaaaccttgctgaccctgaacctcaccgatgaaatcaccgaaacccgtggctacccggatcgcgaatgcgtggcgctcggtgcggcgaacgtggtctccggcgcgttcggtggcatgggcggttgcgcgatgatcggccagaccgtgatcaacctcagttccggtggtcgcgggcgtttgtccggggtggtcgcgggcgtgctgattctgttgttcattttgtttctgtcaccgctgatcgagcgcattccgctggccgcattggtcggcgtgatgttcgtagtgtcgcagcagaccttcgcctgggcgtcgctgcgggtggcgaacaaggttccgctcaacgatgtgctggtgatcatcgccgtgaccacgatcaccgtgtttaccgacctggccacggcggtgctgtgcgggatcatcatcgctgcgctcaacttcgcctggcagcaagcccgcgagttgtacgccgatgagcatctggagagcgacggcagcaaactctatcgcctgcacggcacgctgttcttcgcctcgaccacgccgtttctcaaccagttcgacccggccaacgacccgcaaaaggtcacgctggactgtcgccacttgagcttcgtcgattactcggcgatcgccgcgttgaaaaccctgcgtgaacgctacgccaaggccggcaagcatgtgcaggtgtttcatctgtcggagcgctgcaagaagttgctcaagcgcgccggtgtcgatcacgactgagtcgggcgccgatcagcccttgagccaggtcttgccgaggatgcgcgagacctgatcggcggagtagggcttgggcagaaagtcgtaaccttcgtaaccgctgcgcgccagttcttcgctgtagcccgaggtcagcaccaccggcaggtccgggcgtcgctggcgcagctctttggccagcgcgacgccgctgatccccggcatcaccacgtcggaaaacaccgcatcgaacgccatggcatcggcgcccaccagttgcaacgcttcttcggcgttggtcgcccaagtggtttcgtaacccagatcctcaaggatctgctgggcgaaacggccgacatcgagattgtcctcgaccaccagcacccgacggcggatatccgccgttggcgtctccttgatttcgatgtcttccggcgctgcgaccacgctggcgctgacttgcggcaggtagagcgtaaacaccgtgccctcgccaaccacgctggatacatcgacgttaccgcccgactgcttggcgaagccgaacacctgcgacaacccaaggccggtgcctttgccgacatccttggtagtgaagaacggttcgaaaatatgctcgagggtttttgcgtcgatgccggtgccgttgtcggtcagggtaattgccacgaacggactgcgcgaaccggcatgcgcacgaatcgccggcaacggtttgccgccttccagtcgcagcttcagcagaccctgaccgtccatggcatcgcgggcgttgagggcaatgttgatcagcgcggtctcgaactggctcaggtcggcgcggatgtagcacggctgatccggacgctcgacgctgatatgaatctgcgcgccagtcactgattcgagcatttcgccaatgttcgccagccgctcaccggcatcgacgacttccgggttcaacggctgacgacgggcgaaggcgagcagttggctggtcagtttcgccgcgcgttcgaccgtatcggacactgcgcgcatgtagcgctggcggcgctcgtcggagaggttcggcagccgcaggaagtccaccgaggaacgaatgatcgtcagcaggttgttgaagtcatgggccacgccgccggtgagctggccgatggcttcgagtttctgcgactggcgcaacgccgattcggcatgggccaggcgcacgctgcgctcctcgacccgctgctccagcgtggcattgagttcctccagcgccagcaggccctgacgcacttcggcgtcggcgcgcacgcgctcgatgtgcgcccagcagcgttcggtcacttcactcaacagcgcctgttcgaaccgcgaccaggcgcgtggttgcttgtcgtgaatggccatcagcgcggtcaaccggccttgcttgatcagcggcatgcaaatggtcgcggtgaggccgatggcctggaatgtcgccgattcctcgggcggcagttcggtgcggttgtcgtggatgatcaacggctggccggcgtgcagcagggtcacggctttctcgccgaagtcgcgcaagctgtagtgcccgacgatgcttggcgagcccgccgcggcaaagtcgccgcgaatggtgaagccgtcctcgtcggcatccatgtcggcataggcgcaattggacaggttaaggtgctcgaccatcaggcgcgtgcttgcggcgagaatcgcctcggcgtcgctggcgttggtcaccgcgttgccgatcgcctccagcacagcgaggcgctggttgagaaaaacggtttgagtggtttcggtcacagtgtcgagcaggccgacgatgtggccttgggagtcgcgaatcgggctgtagcaaaacgtgaaatatgcctgttccgggcccgcgccgcggtccaccaccaaaggaaagttttcgatataggtggctttgccggcaaacgcagcctcggcaatcgggctgatctcgcgccaggcttcttgccagactgtactgaaaggacgcccaagcgcctgcggtttgttgccgaggatcggcctgaacgcgtcgttgaagagagtgatcagttcagggccccagacaatcgcctgaggaaaatgcgaagcgagacagagcgagacggtggtcttgagtacatccggccagtgttccaacgggccgaggggcgtgctcgcccagtcgtgcctgcgtatctgttcggccatctcgccgttgtcttgcaaccagtttgtcatagggggtcgggtctttcctgacgtcagcctgtgaaaaaagacccgcgcgcgtggtgtttggtttcagagcaccagaccttggttggcaacgcacacgattcgagcctgtgaacatcatggcacggccaaacgatttgtggcgagagagcacgctccctcgccaccgtttcgatacaggcgtttatcaagcgtcgatggccgggaaatcgatgtccgtcagcgcggtgttgttcagataattggtcagggtctgaaccgccaccaaggcaatcacttcgatgattttcacgtcatcgataccggcggcgcgggcggcagcgatctgcgtgtcgctcaggtgaccacggctctcggtcagttggcgggcgagggcggcgtacgcattgagttcgccctgacgcgccgcgacgatgtcttgcgccgacagccccgacttgccggcaaacaaggtgtgcgccgccaggcagtagtcgcaaccgttgacctgagacgtggcgaggtacaccgcttctttttgctgggcgctcagcgaggtcttgccgaggatcgccgaggcttgcacataggtgtcgagggcaaccggcgctgtagccagtgtcgcgaacagattcggcaggaagccgattttctttttcacgccttccagcacagtgcgggtggcgtcggtggtggtgtcgaggttgatggtgttgatgcggctcatggtgatgctccaaaagtccggtgcgaagtgcgccggcgatggagtgaatggtaggcatcgcgagtagcgctttggcggcaaatcgtcgaggatatgcgacagatcgtccagatatgtcgacgggagtcagccatggatcgtttatccaccttgctcagccattttggcgtgaacgccggaacctttcacagcggcacgttctgcggtgtcgccgtgcacgagggtgaacccgccggccatgtgcatctgttgcaagcgggtgaactgctggtcaagccgggtaacgaacgtgagatccgtctgaccgaaccgtcgctgattttctttccccgaccgtttgcccatcggatgtttgccgacgaagccatgcacagccaggtggtgtgcgcaacgctgacctttgacggtggttcaggcaatgccctggccgccgcgttgccggattatctggtgctgaaactgactgaaatccccgagttggcgagcacggtcgaatggctgttcagggaagctttcgaagggcattgcgggcggatggcggtgatggatcggctgttcgagctgctggtgattttgctgttgcgtcatctgatcagcagccgtgaacagcaaccggggatgatcgccgggctggcggacgcacgtttatcgcgggccttgaattcgatgcatgagcagccgcaaacgccgtggagcgtggccgaactggcgacgctggcgaacatgtcccgcgccagttttgccgagcagtttcgccgcgtggtcgggcagacacccgcggattatctgctgagctggcgggtcagtctggcgcagaagcgtttgcgcgaaggcaagccgattgcgctgattgccgaggaagtcggctacgaaagtccgtcggcgctggcccgggcgtttcggcgcaagaccggcctcagtccacgggaatggaaagccggttcctgaaggtcatttggcgaatctcttcgccccggccacgcacacgatcacacccaaggtcaccgcgagcatgccgaggctgacctgttcgtgcagcaaggtcgccgccaatgccagaccgaaaaacggttgcagcaactgcaactgaccgaccgcggcgatcccgccctgggccagaccgcgataccagaacacaaacccgatcagcatgctgaacaacgacacatacgccagacacagccacgccgacaggctgatctggccgaacgaggcgggcgccagccacacactcgacagcgccatcagcggcaacgccaacaccagcgcccagcaaatcacctgccagccgccgaggctgcgcgacagcttcgcgccttcggcatagccgaggccgcaggccacaatcgctgcgagcatcagcaagtcgccggtgggcgaggcggtcagcccctgagagaccgcgtagcccaccaccagcgcactgcccagcacggaaaatatccagaacaccggccgtggacgctcgccgccacgcagcacgccgaaaatcgccgtggccaagggcaataatccgacaaacacaatcgaatgcgccgacgtcacgtgttgcagggccaacgccgtcagcaacggaaagccgagcaccacaccgagcgccacgatcagcaacgacaaccactgattgcgcgccgggcgccgttcgcgaaacagccacagcaaggccacggccagcacgccggcgatggccgcacgcagcaccgtgagaaacaccgggtcgaactccaacaccgccaagcgcgtggccggcaacgagccgctgaaaatcaccacgccgataaaaccgttgatccagccactggttttttcccggatcggggtgttcagggtcgaggttcgttccatgtctgatcgcgctcggcagtggggttgcgttgtgatcatcctagggtcgagaatcagcacaatcaaaaaattgtcatggatacatctcgcatgccgcgttcgcgctacaagaccatcgtggatgcctacgcggcagacattcgctgcgggcgtctggcgccgggcacgcgcttgccgacccaccggcaactggcggcgcaggaggggctggcgctggtcactgcgtcgcgggtctatgccgagctggaagcgatggggctggtcagcggcgaaaccgggcgcggcaccttcgtgcgcgaaaccgtgttgtcgccggggcagggcatcgatcagaaagacgtcgcggtgggcatgatcgacctcaacttcaactacccgtcgttgcccggtcaggcagagttattgcgcacagcgttgcggcaactggcgttgtccggggacctggaagcgctgctgcgatatcagccccacgccggtcgcgcccatgagcgtgcttcggtggcgcggcatctgctcgcgcgcggcgtgcaggtcgatgccgcgcaagtgctgatcgtcaacggcgcccagcaagggttggcggtgacgttgatggcgttgctcaaacccggtgatgtgattgttgccgatgcgctgacctattccggtttcaaagtgctggctgaggcgctgcatctggaggtcgtggcgatcccggtcggcgcgtacgggccggatctgcaggcgctggaaaaactctgccgcagccgctcggtgcgcgccgtgtacagcatgccgaccctgcacaatccgctgggttgggtgatgccgttggcggcgcgcgaacagttggtggcgattgcccgacagcatgatctgaccatcatcgaagacgcggcctacgcgtttctcgtagaaaatccaccgccgccgttggtgcaattggcgccggagcgcaccgtgtacgtgtccggcctttcgaagaacatcgccaccggtttgcgcgtcggcttcatcgccgcgcctgaaccttcagtgccggcgctggagcgcatcatccgcgccacgacctggaacacccccggcgtgatgacggccattgcctgtggctggctcgatgacggcacggtcagcgtgctggaagagcagaaacgcaacgatgcaaaggcacggcaagcactggcggccaaggtgctgaagggattgccgtacatcggccatccggtttcgtattttctgtggttgccattgccagaagatgtgcgcgccgatcagatcgtggtggcgttgatgcacgagcagatttccgtcaccaccgccgagccgttttccgtatcggcgcatgtgccccatgcgattcgtctggcgctgggttcggtggacatggcggttctgcgccaggccttgaccacggtcaggcagatcatcggcgcttacctgtaaaaactaatgctacccttgcgccgcccgattcacgccgatccggaaccctcgatgaacaactccgcacgcctgtccctcgccctgacgttaaccgccgcgctgttcagcccgctcactcacgcggcgggcgaccccgcagccggggcgaaaatcttcccgcgtctgtgcggtggctgccatcaggtcggcgagtcggcgcgaccgggtttcggcccgcagctcaacggcatcatcggccgcccggccggcacctcggcgaactatgtgtattccgatgcgatgaaaaactcggggctgacctggaaccgcgaaacgctgatcgcgtacctgaaagacccgaaaggcgtagtgcccggcacacggatgattttctgggggctgagtgacgaggagaaggtggaaaacttgctggcctatctgcagagctttcaagccactgcgccataaaactgcggctcaagtctgagcctgatcggcaaaccactgcatgactgaactgcaccccggatgcgccgccgagcccggctgcgggcacaacgcgtaaacccctccagtcttcaacggctccccaaacggcacccgcaacacgccacgctcgatcgactccgctgccagcgtcatgtcagtcaccgccacgcccaagccgcgtgcggccgcgtccagcgccaactcatccagattgaacggaatgtgccggtaattctccagcggctgaccgtcgttggccgccagccattcgatccacgcctgacgatccgccgagcggtgcagcaaggcaaagcgctgcaattcttcgatcgagcgcggtgcatgggccagattcggcgagcacaccggcaccagggtttcctcgaacagcgtcaggcacgccgcgtcgctcgacggctgtggcaggtaaagaatgtaggcatcgctgtcgctcgccggctccaccacttcagtcgccactgtttcaatcgctagcgatatttccgggtggcgcagatagaaatcgctgagcttgggcagtaaccagcgcaccgccagcgacacatgcatgcggatgcgaaacgggcgcttttgtggcgcgaggcgttcttcgagggttttcagttgctcaaggatgctgcgggcgctggccagtaccagttcgccttccggggtcaggcgcaggctgcggctggtacgcatgaacagggccactttgaagtggttttccagttgctggatttgccggctcaccgcgctttgcgtcaggcacagggtctgcgcagcgctggtgaagctggcgcaacgggcgacttcaaccagcgtctgcaaggctggcagggagggcatatggcgaatgttatccatgcgttttccgaatggctcgatgattttatagcgttggtcggtttggcgaagaccttatagattctagctctggtcgcgatcttctcaagcggtgcatgcgattcacgcatgccgaatcagcagaagcaaggcgcagaacgacagtcgaagaggtggagcatggaaaatgtatgtggctggatcgcgcaagccggcagcgcaccgcaaggcgctcgcctgagcggcgcgcaaaaggctgactggctggtgatcggcgctggcatcaccgggctcagcgcggcgcatacgctggccgcattgcatccgcaggcgcgcattatcgtggtggatcggcagcgggcggcgcagggcgcttcggcgcgcaactcgggattcgtcgtggcccatgaacacccggcgcacagcgaattgatcggcgagccgggttttgccggatttgaagtcgataccgccatttcccgcgcggccagcgacgaagtgcgccaacgcattgcccggcatgccatcgactgcgactttcgggacagcggctattacttcgccgtcaacgaccgcgccaaactcgaccacgtcgacgccaaactggccacgctgcgtgcccttggggcgcgggcggaatttcttcagggcgcggcgttggcgcaaaaactcggtacccgtcattaccaagcggcgatctggtgcggccaaggcaacgcgttgctgcaaccggccaaatacgtgaaaggtttgctcaacgctttgccgggcagcattacgctgtacgaggacacagacatcagcggtcttgaacgcctgagccatggacgcctgcgcgccaattcggtagacggcagcattgaggcgaaacaagtgctggtctgcctcaacgcctttgttcccagggtcggaatcgctgacaccgcgacgttcccgatggaactcagcgccagcctcacacggcccctcaccgaacaggagtttcaggccatcggtgcggtcgagccgtggggcgtgttgtcgacccgaccgctaggggcgacggtgcggctcaccccggatcgtcgggtgatgatccgcaacaccgccgaataccgcacgcgcgacctgtccaacggcgaactgactttacgccgccagcatcacgtccgtggtctgcaacggcgctttccgttcctcggcgagtcggacattcaatacacctggaccggtcacctgagcgcgagccgcagcggtcaggcgtatttcgatcgggtcgaggagggcgttttcgccgtcgccggctgcaatggttccggcgtggcgcgcggcacgttgtggggacggttgctggcggaactggcctcgggcatcgattcaccgctgctgcaatcggtgatgcacagggccgagccgggctggttgccgccgcgtccattgttcgacatcggcgcaatgttgcgcatgcgtgtggaggcggtcagggccagaacagaaatctgaatattcaccccattacccaagaacaaaagccactcaactcaggtgatagaacatgcgcatccagccactttttctgacggtcgtgctcgcggccgcatcggcaacggtttacgccgatgaaaccgtcaacatctccaactggaacagctacatcgccccggacaccctggccaatttcacccaggccaccggcattaaaaccacctacgacattcacgacagcaacgaagtgctggagtcgaaactgatgaccggcaacaccggttatgacgtggtcagcccgtcgaaccactttttgtcgcggctgatcaaggccggggcgattcagaaactcgaccgttcgcagttgcccaactggaaaaacctcgacccggtgctgatgcagaaactgcaggtcaacgacccgggcaatcaatacggctttccgtacatgtggggcaccgcgggcatcggctacaacgtcgaaaagatcaaagccatcttcggcactacggacgtcacccgttcatggaagctgttgttcgacgaagacaacatcaagaaactcagccagtgcggcgtggcgtttatcgacaacccgacgcaagtgttgccgatcaccctcaattatctgggcctgccaccgcacagccatgagcccgacgattacaaaaaggccgaacaggcgttgttgaagatccgtccgtatatccagtatttccatgcgtccaagtacatcagcgatctggccaacggcaacgtctgtgtggtgattggtttcaatggcgatatcgttcaggctgcggcgagtgcccgggaagcgaaaaacggcatcgacatcgcttactccattcccgacgaaggcacgacattatggttcgacatgctggtcatgcccaagagcgcgccccacgaaaaaagcgcctacgcgtacatgaattacctgctcgaaccgaaagtcatcgccaacatcagcaacagcatccactacgccaacccgaacgcggcggcccatgaattcctcaatgcagatgtgcagcaggattcagcgatctacccgccgaaaagcgtgctggaaaaactgttcaccgtggaagagttgccagcgaagatcgcgcgcctgaccacgcggttgtggaccaagttgaaaaccaatacgtgagaccggatgcggcaacagggcgctggtctgacgggatgatttgcgctattgctaacagggccggcacaccgccgttacttgggagcaacacgatgaaattgttgatgttggccgcgccgctgttactcgccagcggattggctcaggccgcaatcccgatgttcaacgccacatgcccgggcaagatcgaagtccacgccgatgagggcgggccgatctacatcaatggcaaggaaggcgagctgaagacattcaacgacaactacttcgaggccaagggcgcgggcgtgaccatttccttgagcatcaaccccgatggctcggccggggtctcgtacaccggcaagaacagagccaacggcatttgcgaagtgaagaagagctgatcacgccacctgatttcggcctgccgcttttgcctgatacaactgctggtcggcacgcttgatcagtgcgctgtggctgttgtccgccggatcggccaggccgacgccgatgctcacggtcacatgctcgacgaccgggaagtgcgcctcggcgatggccacgcgaatcttttccgcaacgacctcgggggtgtcgggttgggcgatttccgggagcagcacggcgaactcttcgccgccgtagcgggcgacgaaatcggtggtgcgcaggctgctctggatcaactgcgccaactgcttgagcacgtcatcaccgacggcatggccgtgggtgtcgttgatccgtttgaagtggtcggcgtcgatcagcaacaacgcaaacgggcgcccggtgcgccgtgacagcagcgtgtactcggtgagtttttcgtcgaagcgccgacggttgtaaacgccggtcaagccatcgtgaacggccaggctgagcagttcggcgttggcctgggtgagggcggcggtgcgttgggcgacggtggcttccagcgaggcgttggcctcctgcagttcgcgctccttgccgagcagtgattgcgtcatcgcatccagtgactggctgagctgggcaatttcctgcaccggatgctcgaggggaaaacgcgcaccgggttcgttgcactgaacttgtttggctgaacgcgcgagctgttcgatcggacggctcaggtacagcgccaggtaatacgcgaccagaccgaaaagcaccgccgcgacgacacccagaatcagcaatttatacagtagcaggcgtgccggttgcagcgcggtttccaaaggttggcgcacggcaatcgaccacgacagcgcggtactcgatggcgtcggcacggtgaccatgctggtcaggtagccatcgcccaccgaccagcccggcgcaggcgaattattcgccgccagttgctggcccatcaatgcttcggggtacaacaccttgccgtcgtgatcgacgatcaacgcttcgatgtccggtgcggaattcttatgggaaaacgccgccgattcgacaattcgcgtcacccagctccagtgcgcatgagcaccgagtacgccgatgacctggccttcggcattgtgaatcggcgcagcgaaatcgatgaagcgcagcggttcgccattcggcatgcccggcagcaacttggccagcagcacggcttcatggggatcgccggtgtattcgccgcgcaagccggcctggaaccacgggcgctgttgcaccgattgcccgaccagcaaattgttgaccgcttgatgcacgttaccgtcggcatcggtgacgcccatccacgcatactcgttgcgggcctgggtgcgcaattgcatcgatctcagaatcgccgggttgtccagatcgccgcgctccaggtgcggtgcgcggctgagcagataaacctccagttgccgctcgcgcagttgctcgcccaataacgaggcggccgaacgggcggtgttgagcaaggcattgccactggcctgtttcatttgttcggtggcgatatggccgacatagaagcccacgctcaacagcgtcagcagggacaaaccggtaaaccagagggtgaggtggctgcgcagactggctttgagcatgggcgatgtcggtcttgattggcgtgacgccatggtatgcgacatggtcgatgggctgccagcaaagtgctggatgaaacttgtcgaggttgataccaatgagccatcattttcggtaaggtgtgcgccgcccgagagacggatcccgggcgttttcctatggagttaaaccgtgaagtacttcagcaaagtagtcgccgccgccttgttcggtgcggttctggcaggttgcaccggcaccccgatgaacacccagcagtacgacagcagccaatacaccgtggttggccacagtgaagccaccgccaccggtctgctgctgttcggcgtgatcccgatccagcagaacaaccgcttcgtccgcgcccagaccgccgcgatcaaagccaagggcggcgacgccatgatcaacacccaagttcaggaaaactggttctgggcttgggttctgaccggttacaccaccaagatttccggtgacgtggtcaagctcaagaccgtgcaataagccccggttgaatgcaaaaaagcccggctgatcaggccgggcttttttgtgggcgtgcggtacaactattcaatcatgcgacgcggcgttcgatcagacgatcggagccaccttcagcgacgcggcgctcaatcaggcgatcggaaccaccttcagcaacacggcgctcaatcaggcgatcggaaccaccttcggcaacacggcgctcgatcagacgatccgagccaccttcggcaacacggcgctcgatcagacgatccgagccaccttcggcaacgcggcgttcgagcagacgatccgagccaccttcggcaacgcggcgctcgatcagacgatccgagccaccttcggcaacgcggcgttcgatcagacgatccgaacccccttcagccagacgactttcaatcagcttgtccgaaccgccttcggcgatcagggtgtgagccggggtggcggcaaaagcgttaactgcgaaaaccgagaaagcgatgctgaggatggtttggcgtttcatgatcgtgtgctccagaaggttgtttgtttgtctggagccgatcttacgccgcggattttttatgagaacttcattggcgtgatggtgactatcaacgccaacgatgtttgccaatcccccggattacggggtcttcacccgaacacacaactccccggtggcacgcgtcagcgccagttcatgcagcgcatccctggtcagaccgctgcgtgcctcggccagccatgccgggcaattagggtcttggcgatagggcgtgaattcggcgtactgctgcaatagacgggtctgcagttcgtccagttgcgggcgaatctgcccggcaagatccggacgcggcgtatccggcgccgctccgacggcttgccactgggcgagcaaaccgtactgcaccagtttgttcgcctccatttgcgcggcgagcagttgcgccacgtcttgcgggtcaagcttgcgttcgctggccagcgtgcgggcgttggcgatcacctgcgcttcacgggggctgtcttgaatcggcttgccgctgtcccatttggtcagcgcgacgagatcgccgatgttcaggcgttcgttcagtgtttccagtaacggtttcagcgcttgcggttggctggctgtcggggctgcctgggcggtcgcggcgcagaggacgaagagcgtgccggtcagcacgtggggcaagcggggcatggacaaagcctctttgaagaaattgaaagtgcacggttatttaccacagccgggcgccgacaataaacgtcggtgtgaaatgttaattgcaccccacacgcaactcaccgaagctatccttcattagccctcccgccgtcgagatggacctccagtcaatgcaaacccccgctgccgtcaaacccctctggcacacctacctgttgttcctcgcacccatggtgctgtcgaactttttgcagtcgatgtcgggcacggtcaacagcatctacatcggtcagatgctcggtactcaggcgctggcggcggtgtctgggatgtttcccatcgtgttctttttcattgctctggtgatcggtctcggtgccggcgcgggcgtattgatcggccaggcgtggggcgcgcgtgagccgcacatggtcaaggcgattgccggggcgacgctgttgctcggcgtactgatcggtctggtcgcggcggtgctcggcagtgtgttcgcgcgccaagcgttgaccgggctggggacgccggcggatgtgctcgatgatgcggtggcgtatgcccatgtgatgctgtggatcttgccgtcgctgctggtgtttgtgctgtttacgcaattgctgcgcggggtgagcgatacgttgtcgccgctgttggcgttgatcgtgtcgacgtcggtcggtctggcgctgacgccggcgttgattcgcggctggttcggcttgccgcaactgggcattcagagcgcggcatacgcggggctggccggtaatctggcggcgatggcgtggctggcgtggcggctgattcgcaccggccatccgctggcgccggaccgcgagttctttgccgctttgcggctcaatggggcgattctcggcaaggtgctgcgcatcggtctgccgaccggggtgcagatgattgtgctgtcgctttcggaattggtgatccttgcactggtcaaccaacacggctcgcaggcgacggcggcgtatggggcggtgacgcagatcgtcaactacgtgcagttcccggcgctgtcgatcgcgatcaccgcctcgattcttggcgctcaagccatcggtgccggacgcctggaacgcatggggccgattctgcgcaccggactgttgatcaacgtatgcctgaccggcggcttgatcgtgctgggttatctgctctcgcactggctgctcgggctgttcctcactgaagagccaacccgggtgatggctgaacatctgctgcacatcatgttgtggagcctgctggtgttcggctttcaggcgatcatcggcggcatcatgcgcgccagtggtacggtgctggtgccggtcgccatcgcgatcatctgcgtggtcggcgtgcaactgccagcggcgtactggctcgatgcgcaatatggtttgcagggcgtgtggatggcgtttcccgtggcgtatctgagcatgctggtgttgcagacgctgtattaccagctggtctggcggcatcagaaaatcgagcggctggtgtagaagctgccgcaggctgcgatcttttgatcttgcgccggcgtaacaagaacaagatcaactgatcgcagtctgcggcagctcctgcaagggtggattttctgctgttatccggggagaaagcatcgtaggttacgcgccataactataaggacgtttgagggtgtaaatgggggcttttcgactgctgttggcggtgctggttgccgtttcgcatatgggcgtaaccgtcgccgggctcaatcccggtgtggtggcggtgatttcttttctgatcatcagcggttttgtcatgacctcgctgatcgagcgcaactacagctcaaccggtaaaatcgcatcgttctatctggacagggccctgcgcctgtacccgcagtttctgttctatttcatcgcatcatgcatcgtggtgcatgtgctgatgcccggttcggcacccgacctcgaactgacggtgccgcgcgtggccgcgagcctgtccatggtgccgctgggcttctatatgttcggggtttcgagcctgtggattctgccgcccgcgtggtcgttggggctggagatgtgtttttacctggtgattccctttctccttgtcttcaagtggcgcggcgctgcgttcgctttgtctgtcggtgtgtttgtgctggcgtgtttcggttacatcaacaccgattattatggctatcgcttgttgccgggcgttctgttcatgtttctgtgcggcagctatctgtacaaagccaacagcaaaggattggtagtggtggccgcgacagcgatcagtgccgggctgttgtttgtggcgatcatggcgggcgtgattgaacgccagccttacaacgccgaggtgacgctgggcaccgcgctgggtatcccggcggtgtattggctgagcaggctcaagtatcaccgagccgacgagttcctcggcaacctcagctatggcgtgtttctcaatcactttgtgctgatttactggctgcacggtttctggtcagggacgtacgatgcagcaatcattctggctgtgttgctggtcgcttttttgtgcagcggcctgacttactactgcatcgaacggccagtgttgaaattgcgccatcggcttcggacaggtgtgcggccgggcgccgctgatgttcgcagcgctgaagccctggtctgagcgcaggcacgccagcctgcactggcgtaaccggcggatgtttgcttaagtcaatcgaggccctcgatgtcaggcgccgcccggagaatcccatgtcgatccgattgctgctggcagccgcgtttgtcctgtgcgccatccccgctgcgcaggctgtcgagtacacccgggtcaacacccacgccagtcagatcagtttcacctacaaccagatgggcacgcggatgtacggcaccttcgccaggttcgaagcgacgctggatttcgacactgagcatctcgaccgcgcccacaccacgttgcagattgacctcaccagcatcgacgccggcagcgaggacgccaacaccgaactggtgaaaccggcgtggttcgacacggcaaaattccccgtggcagtgttcgaatcgagccacttcactcagctcgccgagaaccgttatctgattgccggccaactgaccctcaaaggcatcacccgcgatgtgcaagtgccggtggaattgaaaccggacagcgccatcggcattttcgacggcgagttgctgctcaaacgcgacgagttcggcctcggcgcgggggagtgggcggacagcgtggtgtccaaggacatcgcgatcaaattcaaggtggtggcgccacagcagtgagtccgctggctggggtgacaaggtatgatgtcgcggttttctgccggagttcacccgccatgccacgcatcacccactacaagtccccctgcccggaaggcgtcaacagccagattctgcagatggtcgtcgactacctgacggacatcagcgccgtgggcctgggcccgagcaatctgctgtacaacgtttatcagtacgcggtcggctatgaggtgcatttgtatctggaagcgttgaacggtgagaagggcaccgaagtggaattgctcgtagccactgctgaggacgacccggaacaggtcaccggtttcctcctgtacctgccggtgcagggcgattgggaagcgtgcagcgttgcctacatggcggtgcgcgaagggcatcggcgtcagggtgtggcgcgggcgctgatcagcgcaatggtcgggcgttatccccacgcggaactggcctgcaccgtgggtaaagtcccgtacttcgaagccttgggttttgaagtgatcggttcacgggaaacgcaggtattgatgagcacccggcattaccgcagcaacggcctgcgtggatttattgacaccacgccgatttaccggtcgctggaagtgcagcagatccacacctatctgctgcagaaaaacggcaaacgcgcgatgctcgacgctgagaaacaacgcgaccgccacctcgatcagaccagccgccatgtcgaggaatttgtccgccagcgcctgaccgtgcactgacatctcatcagcgaaaaagcccttgccgtgaattccgtagcaagggcttttttgtgtccgcgattcagccgagtttgacgttcatggtgatccgcgccgtgaacacttttttgccctcggtatcgtgaatgtcgacggttacgattttgtcgccctcgctttgccaatccacgccttcaccgctggccactgccgtcacatcggttttcgccttggccagatattccacgctcatgcctttgggaatccagcgtgcgccggccgggatcgacacatcggtcatcatgccggcggcgagttcggcggcgttgcacatggcaatggcatgcacggtacccaagtggttggtgatctcacggcggaacggtacttgcaccgtcgccgcgttcgcgcgcaactcgctcaccagcgggttgatggtgctgaagtagggcgcgaactgacaggccatctgactgaaggcctgcgcacccacactattgaacatgctaagagattgactcatggaaagcctcgcggaagatgatttaccgaatgatgttccgttacagaatatgattctgtaacggaacggtattctgtctgcggtaaatctgtcaacctatgcgtgtttttggcacgggcacggcaagtgcctttcaactccaatctccaggcagtgagccgcatggacaccgtagatttacttgaacgcagctaccccggccgccgtgccgaactcaagcgcgacatctttcgcaaggctctgagcctgttcaacgagcaggggattgaagccactactatcgaaatgattcgcgccgagtgcgacaccagtgtcggggcgatctatcaccatttcggcaacaaggaaggcttggtagcggcgctgtttttcaccgcgctggaagaccaggcgcgcctgcgcgatgcctatctggaggcggcgcaaaccaccgaggaaggcgtgcaagcgctggtgttcagctacgtcgattgggtcgaacgtcaaccggagtgggcacgcttccagtaccacgcacgatttgccgtgaccaaagggccgttcaagaacgaattggcggagcgcaacaagacacgcaatgtgcgtctgcgcgactggctggccgaatcggggcgcgctgccgagctcaaggcgctgcccgccgaactgttgccgtcgttgatcattggtcaggccgacagttattgccgcgcctggttggccggacgggtgaagggcagcccggcggaatatcgcgagttgctggcgctagcggcctggtgctcgattcgtaccgattcgctgccggacagctgatttgcgcagacaaaaaaagagcctcaaagctctttgatggggaggaagtggagcccgtgaggctcaagatgcgcatgcagcaaggcacaggcttgattggggttcagagcccccgtgcctacgcagcgctcgaagagctgagccgctgcgtaattccatcctgggagtgtgcaagtggcggctcaagtaccgccagtcgcccgggcaactagacgctggcctctttcatgaatgttcacagactccctgtaggagctgccgaaggctgcgatcttttgatcttgtcttttaaaagcaaaatcaaaagatcgcagccttcggcagctcctacagtgttttgcggtgtcagcgggcgccgggccagcctgatttttcgagggcagcgagcagggtgtcggcgtcgagtcccggtactgaatgcccgttgccctcggtgctgtcgctggccagcaaggcattgatgatcgcttcttcaaccgcttcggttgcggccaggaacagctcgctgatgtggtcattgttgaccatgcgcaaaccgtcgcaggtcggcgcgcctttgccttcgtaggccgccggcgggacatgagcgttgccagtggcaaaagcgataaagatgtcgccgctgtgatcctcgttgccaccgccggtgcgcgccagacccaggctcgcgcgctgagccagacgtgtgcactgatgcggcaacagcggcgcgtcggtggccaggcagatgacaatcgaacccatgcccggatgcggcaacgatgcccgcaagaacggcgagtttttctgttccatataacgcccgaccgggtagccatcgactcgcaactcattgcgtataccgtggttggcctgcacgatcgcgccgacggtccagccgccctgcacagcgctcaaacgccgcgacgaggtgccgatgccacccttgaattcgtggcagatcataccgctgccaccgccgacggcaccttccatgacggaaccgtcgacggctgcggcgagcgcttctgcgacgtgttcggggtggacgtgaaagccgttgatgtcgttaagcaaaccgtcaaaggtttccagtaccaccggcatgttccagtagaggcgaccgtcgtcgggctgctgctggcgatccagtgcaatcaaggcatcgcgcaccacgcccaggctgtgggtgttggtgaacgcaatcgggctggtcagcaggcccgcctcgcgaatccattcaagcccggtggcgtcaccgttgccattgagcacatgtacaccggcaaaacacggttgcagattggtcgagcccgggcgcggttcgatcagcgtgacgccggtgcagatgtcgcgcccggcgctgctgcggccgcgcacattgctgtggccgacgcgtacgccggggacgtcggtgatggcgttgagcgggccgggcggcagctggccgatgcggatattgaggtcacgggcgcggggtttcattgatggttatctctctaaaaaagtctgagttgctcaccgtcccctgtaggagtgagcctgctcgcgatagcgtcggcactttcaatacaccggtgccggatccaccgctatcgcgagcaggctcactcctacagaggggaaatgtgttggattcactggccgttcttgaccttgctccacacccgcgtgcgcacgcgctcggtggctttgggcaagggttccagggtgtacagcgtggccatcgccgccgcagacggataaaccgccgggttgtcccgagtcgctgcggctaccaacgctgtcgccgcgcgattgccattgggataagacagatgatcactgaccggcgcgatcacttccgggcgcagcagatagtcgataaacgccagaccctgagtacgattcggcgcgtccttgagcagcaccaacgtgtcgaaccacaccggcgcgccttccttgggcaggctgtaggcgatcttcacgccgttgttggcctgctcggcattggtcttggcctcaagcatcgcccccgaccagccgaccgccacgcaaatgttgccgttggacaggtcgctgatgaatttcgacgagttgaagtaagcgatgtgcgggcgcagtttcagtagcagcgcctcggcttttttatagtcttcgggatcggtgctgttgggtggcagaccgagataatgcagggcaaccggcagcatctccgacggcgaatccagcatcgccacaccgcactggccgagtttggcgaggttgtcttcgttgaacaccaggtcccacgaatccaccggcgccttgtcaccgagcgcggcgcgaaccttgtcgacgttgtagccgatgccgttggtgccccacaggtacggcaccgcgtactgattgccgggatcgttgttggccagtttcgccagcaggtcggcatcgagattcttccagcccggcagttgctcgcgcggcagcggggcgagggcgccggccttgatcagcgtcggcaggctgaaattgctcgctaccacaacgtcgtaaccgctgtggctggtcatcaatttgccttcgagtacttcggcactgtcgaaggtgtcgtagaccggttggataccgctgtcgcgctgaaaatcgtgcagggtgttcgggccgatgtagtcgtaccagttgtagacgtgcacgctcggcgcatcgccggccataacggtcgagccggcgccaatactggcgagcaggcccaggttgaggcccaggttgatatagccacggtgacgacgcatgatgcggcactcctggcctgtgcaggccggtgatgaacaggagtggtcagcctatcgggccggtcgcgccggacccattcccatcatgggttactcaaaaggggtagtgcgtggacgcgttgttgcaggaaatgccggtgcatcaaagtctggcacgggtgtttgccgacgtcgggcaggacggcttctggcgtgcgctggtcgacaccttgcgcttgctggtgccgctggacaacgcgctggtggcgttgatgaaagcggggcaggcaccgcaattgctgatcgacttcgacagcaagggtcgatccgacgagcaggaagaactggccgggtacacggccgggatgtacttgctcgatccgttctatctgaccgcgtccaccggcattgccgatggcttgcacagcctggcctcggtggcgccggaccagtttctgcacagtgagtattaccagagctactttcgttcggtggtgggcgaagacgagttgcagttcatgatcaacgtcgacggcggcgtgctcggtttgtcactgggacgctcgacgacgttcactatggctgagcaaggccgcttgctctgcgtgcgcgactgggtgttggcggcgatgcgtcgacacgtgcaactggtgccgccgcaaggcccgcctgcggaaggggtggcgggggatctggcgacgttgctggatcgcttcgatgcgcggctgacggtgcgcgaggtcgatacggcacggctgatcttgcagggcttttccagcaaggcgatggcccagcagatgggcatctcgccggagacggtcaaggtgcatcggcgcaatctgtatcacaagctcaatgtcaccgggcatggtgagttgtttgccctggtgctgcgcccaccaactccctgacccaacacaatccccttgtaggagtgagcctgctcgcgatagcggtctatcagtcaaccaggtgatatctgacacaccgctatcgcgagcaggctcactcctacaagggatcttctgggtgtcaggcggtgcggtggaagaccaaagccttgagaccgctttgcggatcaatatccgcaaactccggcggattctccagccgctctacaaaacgcagactcggcgcttcctgcgtcacgccatcaatcagaaagtccgaaccgaacgccgggtcgttcatgcaggccagcacggtgccttgcgccgtcagcaattccggcaagcggcgcagcacgcgctggtaatccttggtcagtagaaaactgcctttctggaacgacggcgggtcgatgatcaccagatcgtacgggccgctgttgatcactttgccccaggatttgaacaggtcgtggccgaggaaactgaccttgctcaagtcgtggccgttcaaacggtgattgtcgcgcccgcgactcaaggctgcgcgggacatgtccagattgaccacatgatcggcgccgccctcgatcgcggccacggaaaatccgcaggtgtaggcgaacaggttcaacacacgcttgccgttggcctgctcgcgcacccagttgcgaccgtagcgcatgtcgagaaacaaaccggtgttttgtttgaggcccagatcgatccggtactgcagacctccctcgacgatagtcatttcgtcgatctcggcgcccagcagccattcagccgtgctttgcggcaagtaacgatgctggatcaacaacgtgtgcgcgccgcactgctgccactccggtgaacggctgatctccagcagcaagcgcttgaggtcgtccagttgctcgggcagcggttccttgaacaacgacaccagcaccacgccttgcagccagtccacggtcaactgctccagccccggccagcaacgtccgcgcccgtgaaacaggcgacgggtttcgctcggtgccgccgcaagcgcaggcaacagatgggcgtggagggtggcgagggcttcaggggtcatcggtcagggtcggcaaacaaaagggccggcattttaaccacaaatgcgccgttgcgaacgattgccgctgacgggcaaaagcgccgtttcgcaaaagacctgtatcaaaaatgaatttctgtagagcccgctgctcataccagataagcagcggattcaagccgctaaatcgttaatgcaattcagggagtgcagtttcatgtgcccaacaccgacggcggacgcgcaccttcctgacggattgattctggtggttgaggatgatccgttgattctggagtttctctgcgaaattcttcaggaggaaggtttcaaggtcgagccgcacaccagtgctgacgccgcatcgctttatctggagcaacacgcccagcaagtggcgttattgctcaccgatatcaccatgcccggcaccctcaatggcgccgatctggccaacctggtcggtgaccgctggccggacaagccggtgatggtcatgtccggctatgaaacgccggagacctccggggtcaagcattcggtggcgtttatcaaaaagccttgggctatcggccagttgctcgactgtgtggacagcgcgttcaagtccaaggccccgcgcctgcactgacacgttgggtgaatcggcccggcaagtgctacattgctggcccggtttctagccaaaggatgcgacgttttgtctgctcacgattctgttttcgatcgcgcattcggcgcgttcctgttcgacatggacggcaccgtcctcaactccatcgccgctgccgagcggatctggtccgcttgggcggtgcgtcatggcgttgacgtggaaacattcctgccgaccatccatggtgcgcgtgccatcgacacgatcaatcgcctgaacctgcccggcgttgatgccgaggcgcaagcggcgttcattacccaagcggaaatcgaagacgttgaaggcattgtcgagattcccggcgcggcggcgtttctcgacagcttgccgaaagaacgctgggcgatggtgacctcggcgccacgggatctggccttgcggcgcatggcggcagcggggattcctgcgcctgcggtgatgatcactgcggaagatgtgcaggcgggcaagcctgatccggccggctatttactggctgccaaacgtcttggcctggaagcgcgtgattgcctgattttcgaagacgccacggtcggcattcaggctgccgaagcggccggtgcgccgttgatgatcatcaccaccacgcaccagcatgcgctggaaacggcgcatgcgacgttggccagttatgctgctgttcaggtcgaaatcgacagcgacggcaaacttcacctgcaaaaaaactgacacaacacagtcccttgtaggagtgagcctgctcgcgatagcggtgtgtcagacacacagatttgactgacacatcgctatcgcgagcaggctcactcctacagggtgacggtgttcgcaaatcaataaaccccaggcaccaaacgccaactccgcgcgcaataagcatcgtactcaaccccaaactgcgcccgcagcagcgcctcctccgaatgaatccgggcaatcagcggaatcagcgtcagcgccgccagcaacaatcccgccacagagcgaaacgccagcgcccagcccacagcattgatcaccaatcccagataactcgggttacgcaggtgctgatagatgccatcggtgaccaaccggtgccccggctgaatcgccaccaatccactgaaacgccgccccagcacaaacaccggccacaatcgcagcgcgccgccgacgataaacaacaaagcaccgagccagcgcacgccttcaccaccgaaggtccagacattcacccggtcgcagtaggccggcaagaatccgctgaccagaccaatcacgccaaaggccggaatcacccaacgattggcgcggtcttcacgctcgccagcactaaggttgacctcgctgaacagtgaagcgatcaccatggccatcgtcgccagtgccacgatcaccagcgaaccgtgggaaaagaacatcgccacaccgccaatgccccacaccgccagacccagccaagcgagggtggcgagaactgcgacgacggtcatttgcgcagacattttcatggtcaactcacggctgggggctgatttgttcagtgtagaacgctgaccaaaccctgtaggagtgagcctgctcgcgatagcgttgaatcagtcaacgaagatatcgactggcgcgacgccatcgcgagcaggctcactcctacagggtgtgtgtcagtcgtcagtgaggactttgcggaacgtctccaccaacggccgcaaattgacccggtgccacgccgcccataaaggcgtggtcaatgtcagccacggcacctcacgcaacaccactcccggcggtgcgttatggcttaaacctttctggatcatcgcaatccccaaccccgacgccaccagccccagcgcggtaaacggctcggtcgcctgcatgcgcacatccggattgaagcccgcgcggatgcacgcgctgacaaactcatcgttggcatcttgacgcggctgcacgccgatccattcctgctcggccagatcctcggggctcagcacgttctgctgggctaaccgatgatgctccggcaaggccagcagcatcggttcatcgagcacttgaaaacccagcagatccgggtcgtcatcggtcggcggctcactcaccaaggcgatatcgagactacgctgtcgcaagccttccagttgctcggcggaactgaggttgtacaacgcgacgtgcacattcggccgatcggcgcgcagcacgcgcaaggcattgggcaaaactccggcgtgcatggcgttctcgatatagccgatgcacaggccgccttcttcaccgcgaccgaggcgtttgccgagggattccaggcgattggcgtgggtcagcagggcgcgggtttcagcgaggaaggtctggccgtcgcgggtcaggcgaatgcgttgctggctgcgctcgaacagggtcagccccaggcgctcttcgagctgggcgatctgccggctcagtggcgactgggaaatatgcagccgttcggcggcgcggccgacgtgttcttcctcggcgactacaacgaagtagcgcaattggcggatatcgatcatgtcagacctgtagggactcaagtgctgcgcattatgtcttggacggtctcggtgtcgcaatctaggatcagctcaacggtcaaacagacccagaacctatcgaggaaaaaccaatgagcttgaaagacaaactgcccggccagctgggcttcggcaccgccccgttgggcaacatgttccgcgccattccggaagcggaagcgcaagccaccgtgcatgcggcgtgggaggctggcgtgcgttatttcgacaccgcgccgttctacggctccggtctgtcggagatccgcctcggcgaagcactcaagcaatacaaacgtgatgactacttgctcagcagcaaagtcggtcgggtcattctcgatgaagtcgaggatgccgccgcccgcgatctcggcgaaaaaagtggcgtgttcgaacacggtcgcccgaacaagatcgtcaatgactacagcgccgacgcgactatgcggtccatcgaagacagcctcaagcgcttgcagactgatcgcctcgacatcgtctgggtgcacgacatcgcccaggacttctacggcgatcaatggctggaatacttcaaccaggcgcgtaccggcgcgttcaaagtgctgacccgcttgcgcgaagaaggcgtgatcaagggctggggcctgggcgtgaacaaagtcgagccgtgtgaactgaccctcgatctcactgaagcgcaaccggatggtttcctgttggccggtcgctacacgctgctcgaccacgaacgtccgttgcaacgcctgatggatgcggcgctggcccagaacgttgaaatcgtcgtcggtggcccttatagctcaggcatcctcgccggtggcgcgcacttcgaataccagaaggccagccctgagatcatcgccagggtggaacagatcaagcgcatcgccgcggcctataacgtcgatgtaaaagccgctgcattacaattttcgctggccaacccagcggtcgcggcggtgattcccggtgcaagcaaaccggggcggattgctgaagatgtcgcggcgttgtcggcggtcattcctgccggtttctggcaggcgttgcgtgaagcgaaactggtttctgaacgggcgccgttgccggatcacaagatcgcagccttcggcagctcctacatgggaggtgtgcaatgaagattgacttgggtggcaaactggcgattgtcagtggcagtacggcgggcattggtctgggcatcagccagtcgttggccgaagccggggctacggtggtcgtcattggccgcgacaccggcaaggtcgaacaggcgctggcgagcattcgcgagaaagtccctggcgcgcaattgcgtgggttggctgccgatctgggcactgcagagggcgcgcagaaactgttcgccgccgaaccgcgcgcggacattctggtgaacaaccttggcatcttcgacgctgtcgatttcttcgaagcgccggacagcgagtggacgcgtttctatgaagtcaacgtgatttccggcgtgcgcctggcgcggcattacgtgccggcgatggtcgagcagggttggggccgggtgattttcctgtcctcggaatccggtgtggcaacgcctgccgacatgatcaattacggcgtgaccaaaagcgccaatctggcggtatcccacggtttggccaaacgtctggctggcaccggtgtaacggtcaatgcgatcctgccggggccaaccttcaccgatggcctgcaagacatgctcaaggatgccgctgccgagtccgggcgcaacctgcgcgatgaagccgacgcctttgtactcaaggcccgcccgacctcgatcatccagcgtgtcgcggacgttgaagaagttgcgcacctggtcacctacattgcttcgccgctgtcctcagccaccaccggcgcagccttgcgcgtcgatggcggcgtggtcgacagcctgacgatctgaattcccgagagagacgtttatttatgcctacagcatccgcaaccatcgatattccggcttcggccgatcaggtctggcaattgatcggcggcttcaacacgctgcccgattggctgccctttattcccaacagtgaactgagcgacggcggccgcgtgcgcacgctgcaaaccgctgacggcggcgtggtggtcgagcgtctgcaagcgttcgataacgcggcgaagacttacagctattcgattgaacaggcgccgttcccggcgacggattatctagcgacgatcaaggttgaagcccaagggcagggcgcacgggtgacgtggtcggggcggttcaacgccaaaggtgtgagcgatgaggaagtggtggcgctgttcagcggcatctatcagggtggcctcgaggcactgcgcgccaattacccagcctgagctgatgatcgttcccacgctctgcgtgggaatgcagcccgggacgctctgcgtcccattctcaagctggaacgcggagcgtcccttgaggcattcccacgcagagcgtgggaacgatcatgtcgggagtcaggaattctcgatcaagctctgccggcaatcgagcagcagtttcgccccgcccagatcgctgctgccgacttccagactgaagccgtgcaagctgacaatcgcggcgacaatcgacaatccgagaccaaagccaccttgcggctgcccaccctcggcgcgataaaaccgctggaacaccgcctcacgctcagcctcgggaatccccggcccggagtcgtgcacttcaatccgcgtctgcccacccgcgtttacaccacgcaacatcaccgtgccgcccggcggggtgaacttgatcgagttgctcaacaaattcgccaacgcttcgaacaacagcgcccgatcaccgttcagcgctggcaacgtctccggcatgttcaagtcgaaacgcagttcgccttcctcggccagcggcaggtaaaactcgtgcagctcttccagcaattgcaccggatcgagttcgacaaaacctgagcggcgctgccggtcctccagctcggaaatccgcagcaacccgcgaaaccgcgccatcagcgtgtcagcttcggccagcaccagatccagttgcgccgcttcctgcgagccttcgccggcctgttgctgcatgcggtaaagctgcgcgcgcaggcgggtcagtggcgtgcgcaagtcatgggcgatgttgtcgcagacgcctttgacttcattcatcaagcgctcgatgcgttcgagcatggcgttgacaatggcggcgagcatgtccagttcatcgcggcgattggacagcggcaagcggtgcgtcagatcgccggcaacaatcgcctgcgcgctggcctgaatcgcccgtatccgccgcaacggccggcgtcgcagcaaatgccaaccggcaatccccggcagaatcgtcagcgatacgccccagaacaacgcgtgcaaaatgatgcgcgtcaccgcgaacagcgagccgttgtcgcgcaacaacaccagccagcgaccgtcgcgggtttgtgtggcgacggcgtcgcagctgtcattgggcagggtcgggtcgtcggagttggcgcaatcggcgagcatgtggatcttgccgtccagcggcagcccctcggggatctgctgcaacgcgccgccgaggtaaacgccgtcggcatcgaacaagccataggcgtcgatgccgcgaatgtcgaaagtcatgctggcggcgagggcgtcttccagctgtgcgccgcgaaagtgcgaaaacaggtgctgacgttgcatcagcgagtgtttggcgaggttgtcgaggtagccggagacctcgtaatacatgacccccatgaggatcgcgctccacgccacgaacagcgaactgtacagcgccagcaagcggctgctggaagagcgccaaccgtcagacgggttcggcaatgacataacccgagccccgtaccgtgcggatcagcggaacattgcccgccgcgtcgattttcttgcgcaggcgaccaatgtgcacgtcgatcaggttggtgcccgggtcgaagtgatagccccagacttcttcgaaaatcatcatccgcgagagaatctggccgctgttgcgcatcaggaattcgagcagtttgtattcggtcggcagcagcgtcagcacttgctcggcacgccgcgcttcatggctgatcaagtcgagttcaaggtcggccacctgcaacgttgtcgcttgagtggcgccgctgttttgccgacgcagcaacacttcaacccgcgcggccatttcatcggtggcgaacggtttggtcaggtagtcatcgccgccggcccgcaaaccacgtacacgctcgtcgacatcggaaagggcgctgatcatcagaatcggggtggccacgcccatggtgcgcagggtggtgacgatggccaggccatcgagttcgggcaacatgcgatcaagggtgatcaggtcgtagttgccgctgacagcgcggtcgaggccttcgcggccattgtcgacccagtcgacgtcgagcccgtggctgctcagttcggcgacgatttcccgggcggtcacggcgtcgtcttcgatggtcaagatacgagtcataggcaggcctgttgatcggttcaaacggaatggctgcattttgccaagaaaatccgttgacgctttaaattaactttcatgttcacctgtcacaaacgcaaatttcgagcgtgatgggtattcgaggccaatgcataaaacccgctgttatccggcagttgttgcaatttgcaaggttttcggaagttcattctttataactagctgaaattaaacgacttatttaattctcgcgactggcacggtcactgcaattcctctgatgacgagttgtaacaccatttttcatgcctggagcagaacaacaatgaatagatcccctgatgggttttatcccgccgttgaagagtcgagcagcgtttcgggcgtgtcctggggcgcgattttcgccggtgctgcggctgccgcagccctgtcgatgattttggtcctgctcggtttcggtttgggtttctctgccgtttcaccgtgggccggagagggcgtcagcgccaagggcctgggcatttcaacgattgtctggttggcggcgacgcagatcatcgcttccggtatgggcggctacatcgccggtcgcctgcgggtgaagtgggcgaacatgcacggtgacgaagtgtatttccgcgacaccgcgcacggcttcctcgcctggtgtgtggcgacgctggtcaccgcagtgctggtggtcggctcggtcagcagcgtcatcagtggtggtgtacaggccggtgccagtgtggctggcggtgcagccggtgccattacccaagcggccggtactgctgcggcgaacaccgacagcaatcagtacggttactacatcgacagcctgtttcgcgatgaccgtccggcttcggtcagcgatgacgcagcgcatggcgccgtggcccgcatcttcgcccagagcctggccaacggtcagctcagcgccgaagaccgtacctacctcgcgcagttggttgcccaacgcaccaacctgactcaggccgacgccgaacgtcgtgtcgatgaaatctacgcgcgtactcagaaagccctggccgacgccaagctgaaagctcagcaagccgccgacaccgctgcgaaagtcgctgcctggacctcgctgtggatgttcatctcgttgttggccggcgcgttcttcgccagtttcgcggccactttcggcggtcgtcgtcgcgatgcggtcgagtacgttgaagtcgacacctacaccacgaccactccagtccgttaaacaaggagcatcaccatgcgctcactactgctgtttttcctcggcgtaccgatcccgatcattatcctgatcgccctgttcgtgcactgattgctccattgaggcccatgcctcggccgcttccaccttagggtggaagcggctttttgctttctgacgggcaacaaggcgagaatccgcgtcggcaacgggtcggccgttgcgcgcatgtttaaggatgaatacgttggacaggcaagcaatcaaacgacgagtcgtcgaaatgctcgagggcgggcattccaggagcgaaaccttcaaggcgctgtcgggcggcaaggtcaaggatcgagtgctggcgtgctggatcggcgggcgtcgcgatcccgtcctcagaaaacgccacgccgttaaagtcaacatcctggtcgcgctgatgggcatctgggggctgctcggggggatagccgggcttgtgcaaatcaatgacggcggcatcgttatggcggtggccatggtgttgattgtcggcgtaattccgctgttgtttgcatggggtttttatcagggcatcgcggtcgtttacacaatctacatcaccttcacgatcagtcagattccgcgagaattggcaggcttcagtgaagaacccgtgtcgactctgctcggcgtggctttcattctggccatggtgttctacgctgcctgggtcaaatcgctgctgttcccggacctcgccatgatcggcccgaagaagatcaaagggcagttcgtcttcaccaattgatcgttggacaatccaaccgctttcactggcctggatcaatatttcgtccggcgatatcgcctaccgtaaatgatccaagcctttgccgcggtatcgactacattgcctgtacgcgcaccaggttgcgctgacggagtaccgcagtcagaccctcaaaatgcattagaacaacgggtcggcacggtgtagtgcagcaaggagctggcgcaaaactccactgaaattttcacggaagatcattcaatgcactgccaagaaagaaccttcgatatccagcccttggcgcaggcggatatgactgtccacatcaacggtcaagcggtcagcgctgctatcggcgaaaccgtcctgagcgtcattcaatccctcggcgtacgccagattgcccgcaacgatcatgaccagatcagcggcgcctattgcggtatgggcgtgtgccaatgctgcctggtgaaaatcaatggccggcacaaacgccgtgcctgtcagaccgtggtacgcgacggcatgcgcatcgaaacccaggtcaaccgcatcgttgcgcaggaggtcgtatgaacctgcaaccggtgattgtcggcggtggcccggcgggaatggcagccgccatcgagctggcacgccacggtgtgcgcagcaccttgcttgaagaggcttcgcgcctcggcggggtggtctatcgcgggccactgcgtgacggtgtgcaactggattacctcggtccgcgttactccgaagcgctgggcaaactgcacggtgagtttcaggaacagtcgggactgatcgacgtgcgcctcaaccatcgggtggtcggcgccgaaggtactcgcgccctggtagtgctggacggtgacgagcaactgcgcgagatcgaatatccgcaattgctgctagccgccggttgccacgaacgcagtgtgccgttccccggctggacgctgccgggcgtcatcatgcttggcggtctgcaactgcaaatcaaaagcggcgtggtcaagccgcaagggccggtgatcatcgccggcaccgggccgttgctgccattggtggcgacgcaattacatgcctcgggcgtcacagtcgcgggcgtatatgaagcctgcgcgttcggcaagatcgcccgcgaaagcctcgcactgttgaacaagccgcaattgctcctcgatggcttgagcatgctcgcttatctgaaactgcacggcatcccgatgaactacggctggggcgtggtcgaagcccatggcgaaggtgaactgaaaagcgtcagcgtcgcgccgtactcggccacgtgggcgccggacttgtcgcgggtcgaacgcttcgaagcgaagaccctggcggtcggttacggcttcattccacgcacgcaaatcagtcagcaaatgggccttgatcacggtttcagtgatgacggttacctgcgcgcccattcgaatgtctggcagcaaagcaacgagccgcacgtgcatttggccggtgacatgggtgggattcgcggcggtgaagcggcgatgcttgccggcaagatcgcggcgacttcgatcctgctgcaacgcggtgtcctcgaagaagaactggcccgcgtgcgccgcgaccgttatctgggcaaactcagagccatcgtgcgttttcgcgccgccgttgatcgctataccgagcgcggtgtcggacagaccgctttgcccgccgccgacacggtgatctgccgttgcgaacacgccacccgtgccgacatcgatctggcgctggagcagggcgtgcaagacatcgccagcctgaaaatgcgcacccgcgtaagcatgggcgattgccaggggcgcatgtgcgtcggctattgcagcgaccggttacgccaggccaccgggcgcaaggatgtcggttggctgcgcccgcgtttcccgattgatccgattcctttttccgcgttccagtccgtcggcacggaggccgctgcccatgagtaagttctatgacgtgatcatcgccggtggcggcgtgatcggggcgtcctgcgcctatcaattgtccaagcgcaaaaacctcaaggtcgcgctgatcgatgccaagcgccccggcaacgcgacgcgtgcttcggccggtggtttgtgggcgatcggtgaatcggtcggcctcggctgcggggtgattttcttccgcatgatgtcggccaaccgcaagcgcgaaacccagggcgcggcggtggcggtggacgcgagcacgccacacattctgccggagtcattctttgattttgccctgcagtccaacgccctgtacccggggttgcaccgcgagcttaaagaacagcacgggatggatttcaagttcgaaaagaccgggctgaaattcgtcatttatgacgatgaagaccggctctacgccgagcacatcgtcggctgcattccgcacctggccgatcaggtgcgctggctcgatcaggcggcgttgcgcgagtctgaaccgagcgtcagccatgaagcacgcggggcgctggagtttctctgtgatcaccaggtcagcccgtttcgcctcgccgacgcctacatggaaggcgcgcggcagaacggcgtcgacattttcgtcaacaccaacgtcaccggcgtgttgcaccatggcagccgcgtcactggagtgcagacggccgaggagggcgtgttccactgcaagaccctcatcaacgcggcgggcgcgtgggcggcggatctgagcgagtgggccagcggcattcgcattccggtcaaaccggtcaagggccagattctgttgaccgagcgtatgccgaaaatcctcaacggctgcctgaccaccagcgactgttacgtggcgcaaaaggacaacggcgaaatcctgatcggcagcaccaccgaagacaaaggcttcgacgtcaccaccacttacccggaaatcaccgggctggtgcagggcgcggtgcgctgtttgccggaactcaaggatgtgaatctcaaacgcacgtgggcggggttgcgtccgggttcgccggatgaattgccgatactcgggccgatgcgcggggtggagggttacctgaatgcctgcggccacttccgtaccgggattctgacttcggcgattactggcgtgctgctggataagctggtcaacgatgagccgctgccgctggatatcacgccgtttttggcggatcggtttgaggtcacgccagtcaagcaagcgcccgaactcgaactggcctgaaacaatccctgtaggagtgagcctgctcgcgatagcaatctgtcagtaacgaataagttgactgaaacaccgtcatcgcgagcaggctcactcctacatttggattctggcaaggctcaggatttgcgtgattcttcttccagttgatccgactcaaacaaccgcgccagttccgcccgggcttcctgggcggtttgcaggactttcgccgcatcgtcgtaaatcgcgtgttgcgcctccagcacctgttcgtcgtggtgtttgaaacgcttgatccgcgcatcggcctgggcctgggtcaaaccgaggccaaccaatgtgcgtcggctcatttccagacttgagtaatacgtttcccgaatcgcttcagcgcccacatcgaccaaccgatgcacatgctgacggttacgggcccgagcgatgatcttcatgtgcggataaagcttgcgcaccacctcggccgttttgatattggtctccggatcatccgtggcaatcacgaaatattccgcctcgccgaccttggccgcgttgaggatttccgggcgcatcgggtcgccgtagaacaccggcacaccgccgaaactgcgcgacagttcgatggtttccaccgaggtgtccagcgcgacgaacttgatgttctgcgcccgcaggatacgcgcgacgatctggcccatccggcccatgccggcaatcaccacgcgtggggcttcggtgtcgatctcacgatatttttccggcacttccaccggctgcactttcgggctgaccagtcgcgcgcagatcagcagcaacaacggcgtcagcgccatcgacagggtgatggtcagcaccagcaagtcgtacagacgcggctcgaacaggccttgatcgcgaccgatcttgaacaccacaaaagcaaactcaccgccggccgccaacacgatgccaaggcgaattgcactgaccttgttcaagccaccggccaggcgtccgacgacaaacaacagcggcaatttcagcccgatcagcagcaatgtcagccccaacacggtgatcggcgcactcagcagcagactgagattcgcacccatgcccacgctgatgaaaaacagcccgagcagcaggcctttgaacggctcgatctgcgcttccaattcatggcgatattccgaatccgccaacagcaaaccggcaagaaacgcccccaacgccatcgacacgccgaccagatccatcagccacgccgtgccgatcaccaccagcaacgcggtggccgtggagacttccggcagaccggttttcgccaccacgcggaacaccggacgcaacagataacgtccaccaaccaccaccacggcgatgccgccgagcacttgcaaggcgtgattcagatcttcggcggtgctggtggtgtgattgccacccgcgagcatcggcaccaaagcaatcaacgggatcgcggcgatgtcctggaacagcagaatcgcaaatgccagacgtccatgggggctggtcagctcttttcgttcggcgaggctttgcagaccgaacgccgtggacgacaaggcgagtccgaggccgagcacaatcgcgctgtttagcggttggccgaacaccgacaacgccagcacgccgatcaccgaagcggtcagcagcacctgcgccaggccgacgccgaataccgatttgcgcatcacccacaagcgtcgcggcgacagttccagaccgatgatgaacagcagcaacaccacgccgagttcggaaatgtgcgcaacgctctgtggattgccgatcaggcccagcaccgacgggccgatgatcaccccggcaaacaggtaaccgagcaccgcgcccagttgcagacgtttggccaaaggcacggtgagcacggccgcgaacagaaacacgacggcggcttgcaacagattgccttcatggggcatagggttactcctgacaacggtacggcgggggggtgacaaggataagggctacagcgacttttcatccaccgaagatcccctgtaggagctgtcgagtgcaacgaggctgcgatcttttgatcttgcttttgccttcgaagaatcaagatcaaaagatcgcagccttcgccagctcctacaggggatcttcatgtggcctgtaataatttgcatcaattggttacatttataacccctgcgtatcaatctccgcgagtcccgccatggccatcaacttcgacctcaacgacttgcaagccttccgcgccgtggtcgagcagggcagttttcgcaaggctgccgacaccgtgcgcctgtcgcaaccggcgctgagccggcgcatcgaaaaactcgaagacgccctcggcgtgaagctgttcgagcgcaccacacgcaaggtcagcctgacccaggccggacgcggtttcatgccgagtgtcgagcgtttgctggatgatctcgatatcgccctgctggggatcagcgaggtggcatcgacgcggctgggccacgtcaccgtcgcctgcgtgccttcggcggcgtactacttcatgccgcgggtggtcgcccgctatcaccagcaattcccgcggatcaaggtcaaagtcctcgattccagcgcccacgatgtcttgagcgcggtggtcaatggcgaggcggatttcggtttgagtttcttgggtacgcaggatgccaaagtcgatttcgaagcgcttgtgcaggagtgctatgtcgtcgcctgtcgccgcgatcacccgttggccgggcgcaacagcgtgacgtgggacgagttctatcagcaggattacatctcgctggacaagacctcaggcaaccgctttttgctcgatcaggccttgagcaccgtggtgccgcagcggcaaagcatctgcgaaaccaaacatgtgacgacgatgattggtctggtcgaggcgggattgggagtggcggcggtgccgttaatggcgatgccggggccggatcatccgatcctgacacgtattccgctgaccgatccgcaagtgatgcgcagtgtcggcatcatcaagcgccggggccgtacgttgaccccggcggcactggaactggagcggctggtggtggaaatgaaagtccagccgccaacgatcaacgtttgaccgaatccagcccggtggcctgcacgtcaggttgcgcagccggtgcggcgaggtaggcgagcagggctttcgcctcttccggatgttgcgcgccgaccggaatgccggcagcaaaacgcgtcaccgactgcaccgattccggaatcttcgcgacgaagctcacgcccggcaccggtagcagttcgctgacctgctggaagcccagttgatagtcaccggtggcaaccaccgagcccaccgggactttcgcaatcatcttggctttcggtttcagttgatcttcgatgcccagtttcttgaacaactgctgctcgatgtacacgccgctggcgctgtcggagtaggccaccgactgcgcgtcgagtaaggttttctttagattgtcgacgctgctgatgtccggtttcggcgcaccttcgcgcaccaccaggccgatccgcgaatccgccagttcaacacgagaagccgggtcgaccttgccttgcttgatcaaatcatcgagggcgtagccgaccatgattaccacgtcggcgtgttcaccgcgtgcgaggcgattggggatcgcttccggtgccttgcccatcgacggaccgagttgggtgtcgagggtgttgccgctggcggcagcgaatttcggcccgaggattttgtaggcggcggtgaagccacccgacgtcatcacgttcagctgttcagcgtgtgccagggtgctgaaagcgcagagggcgatggcggcgaagttaaagagttttttcatggtcatggttccttatgctgcgaccggttgcagacggccgcccgcgcggcgatagaggtacagcgtggcgcacaacgcgcacagcgcaccgatgctcatccagtaacccggcgcggctttgtcgccggtgtactgaatcaggaaggtcgacattgccggggtgaaaccgccgaaaatcgccgtcgccaggctgtacgcgagggagaaaccggccacgcgcacttccaccggcatgatctcggtcagcgccggaatcatcgcgccgttgtacaggccgtagatgaacgacagccacagcagcgacagcaacatgtggctgaagctcggggcctgcaccaggtacgacagcgccggataggtggtggccagtgccagcagcgacatcgcgatcagcaccggacgacgaccgatgcgatcggacagcatgccgccaatcggcaaccagaagaagttcgacacacccaccagcaaggtcaccagcagcgcatcggacgtgctcaggtgcagcacggttttaccgaaggtcggcgcatacacggtgatcaggtaaaacgcggtggtggtcagggcgaccatcagcatgccgccaagcaccacggcccagttctggccgagggtgcggaacacttcgcccatgctcggacggtgtttgcgcgcggcgaattcttcggtttccgccagattgcgacgcagaaaaaagatgaacggcacgatcatgcagccgacgaaaaacggaatccgccagccccaatcggcaatcacgtccggcgccatccacgcgttcaatgcgtagcccagcgcagcggcaacgatgatcgccacttgctgactggctgactgccaagcggtgaagaagcctttacggcccggggtggcgatctcggacagatacaccgaaaccccgcccaattcggcaccagcggagaagccttgcagcaggcgcccgatcagcaccaacgccggcgcaaagaggccgatgctttcgtatccgggcaccagcacaatcaatatcgtaccgctggccatgatcgacagcgtaacgatcaagcccttgcggcggccgacatcatcgatgtacgcgccgagcacgatggctcccagtggacgcatcaaaaagcctgcgccgaacaccgcaaaggtcatcatcaaggaagcgaactcactgctcgccggaaagaacaccgccgcgatctgcgtggcgtaaaaaccaaacagaaagaagtcgaactgttcgaggaagttacccgaggtgacccggaaaatggcaccggcccgcgagccgccgtgtgggattgaggctgtcataacaaaggactccaccgcttttatgacgtgcgccacggagaggcagcgcacggttcttattgaggcggatggtggcccagctgtaacaggatgttaattgcattattggcatgcattgatgtgcaaagcggatcaatgtgctcgacgcatgctttttgtaggagccgagcttgctcgcgaaagcggcggatcaggcaatgacgaggttgaatgtatcggccctatcgctggcaagccagctcccacaggttttcggggtgcccgcaactttcgctaacaccctggcccctcgtgggagctggcttgccagcgatggcggcccggctgacgactacaatcccccagccagcccaggcaaaaaacaaggaatgattcccgagccgcgcagtccgagttcaggtatcacacatcaatggaggttcaccgatgaacagcaaaaccctaatcgccagcctggccctcgtcgccggcattgccgggatcagcccacttgttcaagcggcgcaaacctcaagcgagcccaccgttcaatccccggtcagcgaccgcgaactcaaggtcaacgaccgcgctccggacatttatcaacgcagcgaaaaagccatcgactggaaaaccaaaggcctgaaaaaaccggttgatcaggcgcagtgggtgcagatcaatgaccagtacgtcatggtgatgatcaccaacgggaccattgtcgagatgcaaccggttccgcgttgagtctccagcgctaattggccatggacgaatgattgtaatcgagcgccgttcgggtaaaacccttggggcgtttcgagtgactgcaagtcaggagcaatcggttggacaagaaaccgctttatcgcaaagtaaacacgcgcacttggggtgttcgacgtaatgaatcggtcgcgcattatcgcgatcagcgcaataccaagaccgagagtcgccgcgaagcatcgcgaggttcaatgcatccaggcaaacgatacgggctggattacacgccgctgttccggttcttgttgtcccgggtgggtggccattgggatcggattttcagtgaagcggtgtctcgcctagatcgtcccgatccgctgttctggatggttgccattcgggaagacgagcgcaaagacatcgtccgattgggcgagtcgagctacttcagtggcctgtacgtcgatgaaaagaaccatctgcaaatcgtcaatcccgacttgaaggccgagaacatgacgccgggttgccagtgctgcactcacaccttcaacggcgttccatttggccagcctgcgaattgaacgggccattccaaccgctgtgactcaacacttgcccaccgcccaaccgatcttgaacccgaacatgccgtagatcgcatccgaccagtacagccgatccgtgtcgacctcccagtcccaggtgccgatgcgggcaaaatactggcggcgcttgaatcgctcggcgtcggcggcctgatgaatattgcgaccttcggcggcgcggctcaacaagtcgcggtattcggcgagttgccgacgcaaaccgcgttcgcgccaaaccagcagggcaatcacggccagcatgatcgtgccgacggcaaggccgatccagagctgaatcatttaggcgctgcctgcatggcgaatcgatccgtggagtagtggcggttggctatgttaatgcttcatcactcaaagcggatacagcgttgatctgcgcgtgcgggttgccaatgaccggcaattctgggaaaacggcggcctgctgaacaatagagtgaatgttatgaatgatgaactgcaggtaatcgatcttcaggtgggcgaaggcaaagccgcggtcaaaggcgcgctgatcaccacccaatacaccggctggctggaagacggcagcgagttcgattcttcctacagccgaggcaaaccttttcagtgcgtgattggcactggccgggtcatcaaaggttgggatcaagggctgatgggcatgcaggtgggcggcaaacgcaaactgctggtgccggcgcatctgggctatggcgagcgaacgatgggcaagattccgccgaattcgaatctgctgttcgagattgagttgctggaggttttgacgcgggaggattgatcaccaggatatcgttcgggagccggataaatggatgtagatcagattatttacaaggccgtcgcgtggctgagtctggagcatgaagggcggcgaggtccgattcacaacatagaaatcctgttgatggggctcggctgtattttcgcaatgttcgtatcgaaaagtgccctggcaaaacgcaaagctttcacggccagcactgcacagaccttgaaagtggcaaccctgaaggcgacgtcctttaccgagaaaagtggacggcaggtcaaaatttcaggcgtattgcttgaggaaagtgacgcctacatcgtcaaagtgacgcatgaggatgaggagggtgaaatcgaatcatccagtgattcactctctacgctggaagacgtcgaagcttatctcagggcccatacgccgttcatcctggcggattttcggcggtgaatgcgcaactgctttcgcgagcaggctcactcttacaggggatgtttgcggcatacaaaatgagtgaacaccgccacacttcgccgatgccggcgcatccaggctatggcgaaaggacgatgcgcaagattccgttgaactccaatctggtgttctagattgatgctggaggttttgacccgcaaggattgaggctggcgagtaccgagttgctttggatgaaggacgcccctcatccaaatgacatgcgacgtatcaggtaaatgcgccgatatcgtcaagcgtatcctcgataatcccgaccagagaggggaattttcccttggctctttcgagcgctggcagaaccgtctcggtatcaatttcgccatgtcggcgagcgatatggcctaaagcggtagcggcagaagccacgattgcttcagtttcgttgaagaggtgtttcaggcagatgtcctgagcccatactctgtccacttcattcaggccgatagaagtcagcgcagcaaccacatttgcggttgttccgttggcaagaagtctattggcttcatcgtggcttattgatggatcttgatagataaggctcactttttggctccgagaatattgcctttgttgtcgactttcttggctttgatcagtgcgttcttcatatcttgatgaagcttgtcccacggacgtacgtggccatggtaggtgtctccacccgtgcgatcaaagaccaccagttcattggcatcaggatcgaccccaattctacgtggcgatgtaggtttgacctggattgaattctccaaagcttcttgcccattagtggggcccttactttttacgggagtatcggttttgccgtgatagctggccgcatcgaactcaagcgcaaaaacgatataaaggggtttgattcctgagtcagtggggaaaaccagtatgaaatcctggtaatccggtgggtagacaggattgaccatgatcctgtcggcttgttctgttggtgggtggatccagatatgtggagtttttggcgcagcttccagcggtggaattcccaatatgcttgacgagtcaatggcgggagtccaagtcagtgttgcaccgttgccgaaatctgcaacgtgctggttgccttgctcgacgaactgtacgaccggaatcatttcccaatcgctgcgtgtctgggtgttgaacccgtatccctttagagtgccgtcggcctgctgttctacatgtagccggacgcgagtgcgaccttcttcaagcgatttgagctggtcctctgtgtacagagaactgtcacccagactcgatggccaaagcagtgcaaccataccgagcaatccacccgcagcgcccccgaccgttagaacgctactgctagtagcggcgccggggccgctagttgcagccgtacctagagcaagagctcctacagcagcgggcaggctacctccgccgatctttttgagaacaacgttgccagtgcgatcacgttcgcgtccacctaacaggcacagttctccaaaatcggatagtttttcaaccggaataaatcccgtggtgctgatgtgattgatgacaccgtctggaagcttgcagctgttccctactaaggttcgactttcagaaattcgtgagcagtaaaaacgccttcgcgagcaggctcgctcccacattggcatggcggtgtactcaaatgctgtgagcaaccgcgaaactgtgggagcgagcttgctcgcgaagaacgattacgcggtcgatcaggctgcgtgcgccatctcggccagttcaccgagttgggcgagggcggtgacggcgcaggcgacaacctgtgcatctgttttgttggtcatggtcattgcctctggtcgggttcgagtttgtcgagggcgcggttgaccgcgagctcgccgagcatgaccacttgctggatgcctagcagggtgttgcggtagggcgtttcgagcaggccggcgaagtcgctgagcatgatgctggccgaggccatggattcgcaggcgtgggccagcagggattcggtgtccatgtccggggcgacgaggaacatggtgctgggcgttcgctggggtggggcgggaggtttgaggtagtggtcgagggcacgttcggcggcctcgttgagttttgtcgggtcgagcgtggagtagggggatactggatctgattcggttgtggcatccgcttctggcggatttggcgttacttttaacatttgcgagacctttaatcagggctgccaacctgtcgcgactaaacgtagggaggcggctgcacgcaggttagtcgaccggtggtctcacaatacccggcgcgccctgaggcgccccgcgcgcagccaccattgagtacagggggttacctgactgaatggacgctttacgaattgtcaaaccaccgagcgactaaacccgatcactgaacattcagtgacgcgaaccaagctaccggcagccctcaaaccgcacaagccggcggattctggcgtagttgtaggcaaaggcgcaaggcgctgtagcccgcacgatgatgccgaaatgatgctgcgtttttccggccgccagcgccgaccccataacttttcgacaccacaaaaacctgtgggagcgggcttgcccgcgaagtggccggcacatccagcaactctgcagtcaggtacgccgccttcgcgggcaagcccgctcccacaggggggagttgttcacaaaaccgcttccaaccctgaacacctgaccggtcttgccattgtcgaagccatcgatgatcattctcaccatataggggtaggaggtataggtatgtcgcacattcaccaacacaaagacgaactgctcaaccgcgtacggcggatagccgggcaggtgcaggcggtcgagaaagcgctcgagggtgatgccgattgcgccaagacgctgcacctggtcgcggcaattcgcggtgcggtcaatgggctgatggagcaattcatcgaggcccacgcccgcgaacacgttgcccttgcgggcctgcgcgacgacgaacgcgcacagggcgttgaagaattgctgcaagccatccgccgttactccaaatagagcgcagacatcatgactctgactccgaaagctgaacacttcagtcacgaccaccagtttctcggcgcttctcacgatgaaaatggccgccgcaccttgtgggtcgtcgtgctgacattcgtgatgatgattgccgagatcgccgccggttacgtcaccggttcgatggcgctgctggccgacggtttccacatggccacccacgctggcgcgttgggcattgccgcggcggcgtacggcttcgcccggcgcaacgcccacaaccgccgctacagtttcggcaccggcaaggtcggcgatctggccggttttgcctcggcgatgattttggggctggtctcgttgggcattgccggtgagtccgttttgcgtttgttccagcccaccacggtggcgtttggcgaggctacggtgatcgcgattgtgggcctggcggtgaacctgatcagtgccttcctgctgatggggcctcacggtcatgaccacggccatgcgcatgctcatggccacgatcatcatcaccatcacgacaacaacctgcgttcggcctacgtccatgtactggccgatgccttgacctcggtgctggcgattgccgcgttgctggccgggcgttatctgggttgggtgtggctggacccggtgatggggattgtcggtgccatcgtcattgccaagtgggcgtacaacctgatgcgcgacagtgctgcggtgttgctcgacgccaccgatgagccggtggctgcagagattcgccagctgctggaatcctccaacgacgtgcgcatcagcgacctgcacgtctggcaagtcggcccgcaggcgcgggcggcgatcgtcagtgtggtcgcggcagcggatgtcacggcgcaagcgattcgcgagcggttggcgccagtgcatgagctggcgcatctgaccatcgagctgcgtaacgcttaagccgtggctgcgctgaacatcgggatgcgcccgttgagagacgggcggtactgccagtgcagccggttcgggtcgacgccgtgagcgaggagttcgctgaccgtcgcactggcgatactcatcgccagcaactgccccgggcaatgatgccggccactgccaaaactgaaactgcgccgattcgtgcgctccagcaaaaacgcgtcgggctgttgattgagcgccggatcgcgattggccgaggccagcagcaccagaatcacatctccagcctcgacccgaacgccatcaatctcacaagcctgagccacaaaccgtcgggtgttttgcactggcgggtcgaaacgctgcacttcggccaacaacgcctgcgtcggtgcaccgcgcaactcaggttgccgtcgcaacgccagcagcgcgttgccgatcaatcccgcagtggcttcatgagtctgtgaacaaagcccgatcagattggcaatcaacgtttgttcagcgccgtcaaatcgctgcttgatcgccgtcagcaacgcgctatccgcttgcgccagcaactcgatgaaataatcgcgcaaccgctccgccgccgaatgtgcggccatcagctgcaggtcattgctcaatggcgacaggcaggtgacgaagtcggcggtcagctcactgacggctcgaccctgtgccggggtgaagccgagtagcgccgcaaccacgcacaccgggccgcgaaacatggctttatacaggccgtcggtgtttacagtgatcagtcgcgcggctaccaatgctcgtacttgggcctcatcaatcaactcaagcgcaggctcgatcgccgaacgcgggcagcgctgacgctcgccatcattcatccgcatcaattgcccgaacacctcgcccgccatgcccgaagcaatcgccgtgggcaccggttcctgcgccggacgcacccggcaatcggtatgcgccagcaccgcacacaccgcccgggcactgctggcgacccacagtctcagttcgtgatgaaacgtgaatccgccctgagcacgcagtccggcgtaataaggataggggtcggcatgagtcgcagcgctgatcgggtccatggttcgcagccttgtcgtcgagaaagtgatgcgagtatcgtcagtgctcagcggtgatgattcgtcggggagcgaaatatgcacgcagaacatcaagacatcggcgtctcgcaggtggctgccgccatcgcggagccggcgcgaacgaaaatcctctgctcgctgatggacggccacgcgcgcaccagcaccgagttggcggccatcgccgaagtcagcgcgtctaccgccagcgcgcacctggccaagctcaaggatctggcgttggtgcgcctgcacgtgcagggtcgtcatcgttattacagcttggccgaccaacgcgtggcccaggcgctggaagcgctgatggtgatcggccagagcgccacaccgaccttcaaaccgcacacgccggatcgcctgcaattcgcccgcacgtgctacgaccacatggcggggacgctggcggtgttgctgcatgaccgtttgctcgaggcggggtggctggacgagtcggacaagcaagcgtattgcttgagcgacagtggcgcggcgttgttcgaaggcttgggcattgaagtgcgggatttgactacgttgcggcgcaagtttgcctgcccgtgcctggactggagcatgcgccgcccgcatctcggtgggtcgctgggggcggcgctgttgcaaaccgcgttgaagcgcaggtggctgacgcaggatctggacagtcgggcgttggcgttgacggtggtggggcgcagggaaatcgccgtgcggtttggcgttgagttggcgaatgaaaatggccagatcaaaagatcgcagtctgcggcagctcctacagggcgggtgtacacccgatgaatcccgatcccgaatctacgtaggagctgcgggacgctgcgatcttttgatcttcgctctaagccgacgaggggtcgtgcccaaccttgtgcccacgttcgtgacgctatactgtatatccaaacagtaaagagcccgcgccatgcaaatcatcgacaagctgagcatcctcgccgacgccgccaagtacgacgcgtcctgtgcgagcagtggcgcgcccaagcgcagctccgagggcaagagcgggctgggctcgaccgatggcatgggcatctgccacagctacacgccggacgggcgttgcgtgtcgttgttgaaaattctgctgaccaatttctgcctttacgattgccaatactgcgtcaatcgccgctccagcgacgtaccgcgggcccgcttcacacccgaagaggtggtgacgctgaccctggatttctaccggcgcaactgtgtcagcgggctgttcctcagctccgggatcatccgctcggcggactacaccatggagcaactggtgcgggtggcgaagctgttgcgcgaagaacatgagtttcgcggctacatccatctcaagaccattcccgacgccgaccctgcactgattgaggaggcggggcgttacgccgatcggctgagcgtgaacatcgaactgcccaccgatgccagtttgcaaaccctggctccggagaaagacatcgcttcgatcaaacaagcgatgaacacaatttacaccggtgtgcagaccgttttgaacgaaccgcgttcggcgaagttcgcccctgccgggcagagcacgcaactgattgtgggcgccgatgacactgacgacagcacgatcttgcacagtgctcagtcgttgtacggcaactaccgcttgcgtcgcgtttactattcggccttcagtccgatccccgacagcccgaaaagcgtgccactggccgcgccgccactgatgcgcgagcaccgtttgtaccaggccgatttcctcctgcgcagctacggttaccgtgccgacgaactgctcaaggggccgggcaatctggccttggacatcgacccgaaactggcgtgggcgttgcaaaatcgcgaggtgttcccactggatctgaaccgcgccgaggcgtcattgatcgcgcgtattcccggcattggtttgcgcaccaccgaacgtctggtcgagctgcgccggcaacgcaagatccgctacgaagatgtcgcacgcatgcgctgcgtcctggccaaggccaaacccttcatcattaccagcgactaccatccgcagcaggccgaggtcaccagccacttgctctatcagcaattacgcgaccggccgatgccgcaacagatggggttgtggggatgatcaatctcgactgcgacgatctgttcgacacctggcgtcagcaggcacgctggctgctcagccatgaagtcgatccgagcctggtgagctgggcgtcggaaggcgtgggcgatctgtttgccagtgatgcccctgtgcctgaagggcagggtccatttatggcgaagatcccgcgtgtactgctcgaaacgctggagcacgccgcgcaataccgtggtgatcaacgctggagtctgttgtacgaagtgttgtggcgcgtcagccacggtgatcgcacggcaatgatggccggtgacaagctgggcagcgagttgcagcggcgaatcaaacaagtgcgccgcgaagctcatcacctgcatgcgtttgtgcgcttcattgaacggccgaaaaacagccaaggcccgcaatacgtggcgtggcacgaaccggctcacgacatcctgctcagcgccagcgagcatttcgtcgggcgcatgggccagcatcgctggctgatcgccacgccgcgtgacggggtttattacgatggcgaacaactgatccatcagcgccaatgcccgctggaatggcagcaactggcgcagaatgtcgacgatcctcacggtgatctgtggctgacttattacagccacatcttcaatccggcgcggttgaacgagaaggtcatgcaggggcatttgccggcgcggttctggaaaaatctgccggagggggagttgattccggggttgattacgcaggcgcggatgggcaagcagcagaatgggcaggcgagtgggattgccagtcggtccgggaagcgcattgccttgaaatagaaaatcaaagatcaaaaaagccccccatcgattactcgatggggggcttttgtgcatcaacgaacgtcagatcaaaccttgacgatccagcccgctggcgcttcgatgtcgccggtctgtacgcccgtcagctctttatagagcttctgggtcactgggccgacttcggtttcgctgtggaacacgtgcagatggtcgttgtagctgatgccaccgatcggcgtgatcactgcagcagtaccgcaagcaccggcttccttgaagtccgacagcttgtcgatcagcacgtcgccttcaaccacttccagacccagacgggacttggccagttcgatcagcgacaggcgggtgatgcctggcagaaccgacggcgagttcggggtgatgaacttgttgtcgtgggtgatcccgaagaagttggccgaaccgacttcctcgatcttggtgtgggtcatcgggtccaggtagatcgcgtcggcgaagttggctttcttcgctttcgagcccggcatcaggctggcggcgtagttgccaccgaccttggcggcgccggtgccttgtggggcggcgcggtcgtagctggagatctggaagttgtgcggggtcaggccgcccttgaagtaggcgccgaccggaatgcagaagatcgagaagatgaactcgggtgccgtgcgcacgccgatgttgtcacccacgccgatcacgaacggacgcagatacagcgcgccgccggtgccgtacggcggaatgaaacgctcgttggcacgaaccacggctttgcacgcttcgatgaactgctcggtgtcgaccgtcggcatcagcagacgcgcgcagctgcgttgcatgcgcagggcgttctggtccgggcggaacaggttgatcgagccgtccttgcaacgataggccttcatgccttcgaagcactgctggccatagtgaagggcagtcgagccttcgctgatgtgcagcacgttatcttcggtcagggtgcctttgtcccactcgccatcgcgaaagtacgacagatagcgtttgtcggtcttgatgtagtcaaaacccagcttgtcccaattgatgctttcgttacccatgacaccctctatcactgaacaaccgtcgaaacggttcaaggcttctgacgttttttggatgggcacaacaatacttcattcttgagcggtttcgcagcccggactatcggatgacaggcagataaatcgcgttgttctcaagaaatcgcgagcaggctcactcctacaagggaatgcattccaaaatgtaggagtgagcctgctcgcgatggggccatcattgccaccctcactcacaggtggagtgcatggccaagggcacgcaacgccgcctcctgcaccgcttcacccagggtcggatgcgcatgaatggtgccgccgatgtcttccagccgcgcgcccatttccaggctttgcgcaaacgccgtcgacaactcggaaacccccacgcccaccgcttgccagccgacaatcacatggttatcccgacgagcgaccacgcgcacgaaaccgcttttcgactccagtgtcatcgcccggccattggccgcaaacggaaaactggaaacaatgcagtccagccccgcagcttttgcctcgtccggtgtcttgccgaccaccaccagttccgggtcggtgaagcacaccgcagcaatggctgtcgggttgaactcacgggttttgccgctgatcaactcggcaaccatttcgccttgggccatggcgcggtgggccagcatcggctcgccgctcagatcgccgatggcgtagacgttgcgcatgctggtctggcagcggctgtcgatcttgatcgccgagccgttcatgtccagattcaacgcttcaaggttccagccctgggtattcggtttgcgaccgacggcgaccagtacctgatcggtttccaggttcagggtttcgccctctgggtcgcgcacctgcaacatgccgtcgaaacccagcacactgtgtttcaagtacaacttaacgccgagttgcttcaacgcgtcatgcaccggttgcgtcagttcagcgtcgtaagccggcaggatacgatcctgcgcctcgaccacgctgacctcggcgccgagcttgcgataagcaatgcccagctccagaccgatgtaaccaccgcccaccaccacaagacgttttggcacggatgtcggcgccaacgcttcggtggaggagatgaccggcccgccaatcggcaggatcggcagattgacgctggtcgaaccagtagcgagtaccaggtgctcgcactggatgcgcgtgtcgccgacatcaacggttttgccgtcgatgactttggcccagccattgatgacctgaaccttgttcttcttcagcaacgcagcgacgccggtggtcaggcgatcaacgatgccatccttccactcgacacttttagtgatgtcgagcgtcggcgcggcaacgctgatgcccagcgccgaatgctgattgtgatgctgagtctgttgaaactgctcagccacgtgaatcagcgctttcgacgggatgcagccgatgttcaggcacgtaccgcccagcgattggccttccaccagaatcgtcgcaatgcccagttgcccggcgcgaatcgccgttacatagccgccagggccgccgccgatgatcagcagcgtagtgttcagagattgcatgcgcgccttactccacaaacaaagtggcaggttgttcgatcaagccgcgaatggcctggatgaagagtgccgcgtccatgccgtcgaccacgcggtgatcgaacgagctggagaggttcatcatcttgcggatcaccacctggcctttgacgaccatcggccgttcgacgattttgttgacgccgacaatcgccacttccggcaggttcagcaccggcgtgctgacgatgccgcccagtgcaccgaggctggtcagggtgatggtcgaaccggacaactcatcgcggctggccttgccattgcgtgcggcgctggccaaacgggaaatctcggcggcgctgtcccacaggctgcgcgcctcggcgtgacgcaccaccggcaccatcaggccgacatcgctttgcgtggcgacgccgacatgcaccgcgccgaggcgggtgatgacttgggcttcgtcgtcgtaacgggcgttcatttgcgggaagtcgcgcagggcgacgaccaaagcgcggacgaggaacggcagcaaggtcaacttgccacggctggcgccgtgtttttcattcagatgcgcacgaagttcttcaatcgcggtaacgtcgatttcttcgacatagctgaagtgtgcggcacgctgagtagcgtcctgcatgcgctgggcgatcttgcggcgcatgccgatcacttgaatctgttcttcgtcgttacgctgggcgtaagcggcggcgactggtgccgaagcgttcgactgaccttgcgccaagtaggattcaaggtcttcgtgcaacacacgaccggccgggccggaaccgcgcaccagacgcaattgaatgcccagatccagcgcatgtttgcgcacggccggagaggcgagcgggcgttcgtctgcttcgcgagcaaccatcgggccttggcaaaccgcagccggacgcgacgcggctggagcaggtttgctctcaacaacggtttcaactttcggcgcaaccagtgcttctttagccggcgcaggtgcggcggactctttcaaattaccggcaccttcaacctcaatgctgatcagcacactgccaaccgccatcacttcacccggctgaccaccgagggcaatcactttgccgtgcaccggcgagggaatatcgaccatcgccttgtcggtcatcacgtctgccagcacctgatcttcaaccaccagatcgccaaccttgacgtgccactgcgacagttctacttctgcgatgccttcgccgatgtccggcatcttgataacgtgcgtgcccattcagacctccataacccgtttcaacgccgcgcccactcgggacggccctgggaaatacgcccactcttgcgcgtgcgggtagggggtgtcccaaccggtgacgcgctcgatcggcgcttccaggtgatggaagcaatgctcttgcaccagcgacaccagttcggcgccgaaaccgcaggtacgggtggcttcgtgaaccaccacgcagcggccggttttcttcaccgacttgacgatggtgtccagatccagcggccacaggctgcgcaggtcgatgacttcggcatctacgccgctttcttcagccgcgacttgcgacacatacacggtggtgccgtaagtcagcacggtcacgtccttgcccggccgcgtgatcgcggcaacgtccagcggcacggtgtagtaaccgtccggaacctgcgcttgcgggtgtttcgaccacggcgttaccgggcggtcgtggtggccgtcgaacgggccgttgtacaggcgtttcggctcaagaaagatcaccgggtcatcgttctcgatggaggcgatcagcaggcctttggcgtcatacgggttggatggcatcacggtgcgcaagccgcacacctgggtgaacatcgcctcgatgctctggctgtgggtctggccgccgtagatgccgccaccgcaaggcatgcgcagggtcattggcgcggtgaactcgccggccgagcgatagcgcaggcgcgccgcttcggaaatgatctggtcggaagccgggtagacgtagtcggcgaactgaatctcggcgaccggacgcaaaccgtaggcgcccatgccgacggccacaccgacgatgccgctttccgagattggtgcgtcgaacacccgcgaggtgccgtacttggtctgcaggccttcggtgcaacggaacacgccgccgaagtagccgacgtcctgaccgaacaccaccacgttatcgtcacgctcaagcatcacatccatggccgagcgcagggcctggatcatggtcatggtggtcgtggtcatggcggtttccaactgaatattgttgttgtggtcgttcatgtcagatccccaactgctgacgctggcgcttcaagtgctccggcatctctttgtagacgtcttcgaacatggtcgcggcgcttggaatctggccaccggcgagggtaccgtactgttcggcctgtttctgcgcggtaatcacttcggcttcgagttcggcgctgacggcggtgtgttcttcctccgaccagtgaccgaccttgatcaggtgctgtttcaggcgcgcaatcgggtcgccgagcgggaagtggctccagtcatcggccggacggtatttggaagggtcgtccgaggtcgagtgcgggccggcgcggtaggtgacccattcgatcatggtcggaccgaggttgcggcgggcacgttcggcggcccaggcggatgccgcgtaaaccgcgtagaaatcgttgccgtcaacgcgcagcgaagcgatgccgcagccgacgccgcgtccggcgaaggtggtggcttcaccaccagcgatagcctggaaggtcgaaatcgcccattggttgttgactacgttgaggatcaccggcgcgcgataaacgtgagcgaaggtgagggcggtgtggaagtccgattcagcggtagcgccgtcgccgatccacgccgaggcgattttggtgtcgcccttgatcgccgaggccatgccccagcccacgccctgaatgaactgcgtggcgaggttgccggaaatggtaaagaaaccggcgtccttgaccgaatacatgatcggcaactgacggcccttgagcggatcgcgctcgttggacagcagttggcagatcaggtcgaccagcggcacttcgcgagccatcagaatgctttgctgacggtaggtcgggaagcacatgtcgtcgatgttcagggccagggcctgagcgctgccgatggcttcttcgccaaggctctgcatgtagaacgacattttcttctgacgctgggcgaccaccatgcggttgtcgtagatgcgcgtcttgagcatggcgcgcatgcctttacggaggatctcgaccggcacgttctcagcccatgggccgagggcgttgccctgatcgtcaagcacgcgaatcagcccacgcgccaggtcggcggtgtcggcaggttctacatcgacgggaggtttgcgcaccgtaccggcatcggtcagatgcaggtaggaaaaatcggttttgcagcctggacggcccgagggttcagggacgtgcagacgcagcggttcatacgcttgggtcatggcttctacgctcgatcttgtgaatttcttgtagtgagctggcagtcattcttcggtagaagaaatcttgtcctacaacaatcataggcccgggcaagaagaatatttatctctgtttcgttgcgctggagacgatttgcagatagaaattctgcataaacataaaaaacaggtggttttgtctcatgcgcaaactggaccgtaccgatatcggcattctcaacagccttcaggagaacgcgcgcattaccaacgccgacctcgcgcgctcggtgaatctgtcgccgacaccatgcttcaaccgggtcaaggccatggaagaattggggctgattcgcgagcaggtcacgctgctggatgccgacctgctggggctgcacgtcaacgtgttcattcacgtcagcctggagaagcaggtcgaggaagcgctgcagcattttgaggaagcgatttccgatcgccccgaggtgatggagtgctacctgatggccggcgacccggattacctcatccgggtcctggtaccgacgattcagtcgctcgaacgcttcatgatggacttcctgaccaaagtcccgggtgtggcgaacatccgttccagctttgcgctgaagcaggtgagatacaaaactgcattgccgctgccggcaaacggtttgacgttggggacgtgaagatcaaaagatcgcagcctgcggcagctcctatagggaaaacgcgttccaactgtaggagctgccgcaggctgcgatcttttgacgttaaagcttgttgatcgggattttcagataaaccacgccgttgtcttccgccgccggcagattccccgcgcgcacattgacctgaatcgccggcagcaacagcgtcggcatacccagcccggcatcgcgcttggtgcgcatttcgacgaacgctgcttcatcgatcccgtcatgcacatgaatattgcttttgcgctgctcgccgaccgtggtctggcactgcgaggcgcgactctcgggcggataatcgtggcaaacgtagagttttacgctggcggggaaggccagcagtttgtggatcgaggcaaacagctgatgggcattgccgccgggaaagtcgcagcgcgccgtgccgacatcgggcatgaacagcgtgtcaccgaccagaatctgctcgccatcgatcaaataagccatgtccgccggggtgtggccggggacgtgcagagcggtggctttaaggttgccgatgcggaacgactcgttcggcgcgaacaggtggtcgaactgcgagccgtcgacgcaaaactccggctccagattgaacagtgccttgaacacgtgctgcactttgctgatcgattcaccgatggcgatcttgccacccagttcccggcgcagatagggcgcggcggacaggtgatcggcatgcgcgtgggtttccagcaaccactgcacctgcagattgtgtgcgcaaacgaaggcgatgatcttgtcggcctgggcggtgcaggtacgtccggcggcaccgtcgtagtcgagtaccggatcgacgattgcacattgcccgccgtcggcttcatagaccacatagctgtaggtcgaggaggcggagtcgaggaaagcttcaatctgtgcggacatggacaccaacctgaacatggaaaatgggttgcaacactttatctaaaaacataatgttcgcagcttaagtgacgttgaaggcatcgtgcaaatgcaatccagtctgaccgaatgtgaagtcgcgcaactgcgtgcctcggcctccaaggcctgcgcgctgctcaaggccttggccaatgaagatcgcttgctgatcctctgtcaactgacccagggcgaacgcaatgtcggcgaactggagaaaatgaccggtgtgcgccagccgaccctgtctcagcaactgggcatcctgcgtgatgaagggctggtcgcgacccggcgtgagggcaagtacattttctacgggctcgccagtcacgaagtgattcaagtgatgaagaccctgtcggggctttattgcggtgccgtcctcaaaagctgggaacagccataaatgccagccttcacaccatcccccctgtaggagtgagcctgctcgcgatagcggtgggtcagccaacatatttatcgactgatacaccgctatcgcgagcaggctcactcctacaatggatttgtgtgaaggctgagaaatccttgcgtgcagcaaaaggaacaagcaatgaacgatcaacactggggcccatccatcagtgcggacatcgtggtcatcggcggtggtacggccggcatcggttttgtcgccagtctgctcaagcgtgatccaggactgagtatcacggtcatcgagccgagtactcaccattactaccaaccggcgtggacgctggtcggcggtggcgcctatgacgtgaaaaacaccgccagaccgatgagcaaggtcatgccccggcaagcgaactggttacaagcggcggtcaccgcgatcgacccggaccagcgcctgctcaccctcaacgatcaacgcaccgtcagctatcaaaacctgatcgtctgccccggcctgcgtctggcctgggagaaaatcgaaggtttgcaggaaagcctcggccaccacggcgtcacctccaactacagctatcaacacgcgcaatacacttgggatcaggtgcagaaactgcgcggcggcaaagccctgttcacccagccggcgatgccgatcaaatgcgccggcgcgccgcaaaaggcgttgtatctgtcctgtgatcactggcgcaaagccgctgtgctgaacaacatcaatgtcgaattcaatctggccggcgccgcgctgtttggggtggcgacgttcgtgccgccgttgatgaagtacatcgagaaatacaacgcgcaactggcgttcaattcgaacctgatcaaggttgacggcccgtcgaaaaccgcgtggttcgagatcaaggacgccgacggcaacctcactcgcgtggcgaaagccttcgacctgctgcacgtggtgccaccgcaggtttcgcccgacttcatcgcgcaaagtccgctggccgacgcagccggctggtgcgaagtcaacccgcacagcctgcaacatccgcgttatcccgaggtgttcgcactcggtgatatctgcggtaccagcaatgcgaaaaccgccgcagcggtgcgcaaacaagtggtcgtggtcgcggaaaacctgctggccctgcgtcagcaattaccgctgccgctgaagtacgacggctacggctcgtgcccgctgacagtggagaagggcaaggtgatcctcgccgagttcggttacgccggcaagttgctgccgaccttcccgatggacccgaccgtggcgcggcgttccgcgtggtttctcaaggcgacgctgctgccgtggttctactggaacggcatgctcaaaggccgcgagtggctgacaggtctgtcaaaggtcgactgagaaaaccctatgttgctggcaagtctgtttggtgtggtgatgggattgctcctcggtttgaccggggccggcggcgggattcttgcggtgccggcactggtgctcggccttggctggacgatgacgcaagccgcgccggtggcgttgtttgcggtgggcagtgcggcggcggtcggcgctatcgacggcctgcgtcatggtctggtgcgctatcgcgcggcgttgttgatcgcggcgttgggcgcagtgttttcgccgttggggatctacttcgcgcatcagttgccggagaagattctgatgattctgttcagtctgctgatggtcatggtggcctggcgcatgctgcgccgcgaacgtcagcaggaggggccgagcgatcatggccacgccagttggggccagaagaactgcatgctcaatgaagaaaccgggcgctttgactggacggccaaatgcaccgcgaccctggcagctttgggcgcgatcaccggggttgtttccggtttgctcggtgttggtggcggcttcttgattgtgccggcgttcaagcaactgaccgatgtgcaaatgcgcgggattgttgcgacgtcattgatggtgatcagcctgatttcggcgattggcgtgatcggatcgtttcacgccggtgtgcgaatcgacgggcagggcgcggcgttcatcgtcgccagcattgtcggcatgatcatcggccgcaagctctgtgcgcgagtgccggcgcgggcgttgcaggtgggatttgccagtgtctgtctggtggtggcggggtacatgttgttgcgggcgtaaggcaaaaatcgcagcccgttgagggctgcgatccgttaacggcttacaacaccagatgcggcaaccacagcgaaagtgccggcacgtaagtcaccagcatcaacaccaggaacagcacggcatagaacggcagcagcgctttcacggtgctctcgatactgaccttgcccaccgctgaaccgacaaacagcaccgcacccaccggcggcgttatcagtccgatccccagattcaccagcatgatcatgccgaactgcaccgggtccacaccgatgccgagaatcaccggcatcaggatcggcgtcaggatcaggatcagtggcgccatgtccatcaccgtgccgagcaacagcagcatgacgttgatgcacatcaggatcacgtagcggttgtccgacagggtcaggaacagcgtggtgattttcgccgggatctgcatcagggtcatgatgtagccgaagctcgcggcgaaaccgatcaggatcatcacgatcgaaatcgtccgcaccgtgcggtgcatcagtttcggcagctcgcgccacttgtagtcgcgatagatgaacatggtgacgaagaatgcccagagcacggcgatcgccgccgactcggtcgcggtgaagataccggacaggatgccgccgaggatgatcaccatcgccatcaggccccagagggcttcgccgacgattttcaacgcctggcgcatcgggatcacttcacccttgggataatcgcgctttctcgcgaaaatcagacacagcaccatcaggcaggcgctcatcagcaagcccggcacgatgcccgccatgaacagcgaggcaatcgaaaccgtgccaccggcggccagggagtaaagcaccgagttatggctgggtggggtcagcagggcttgcaccgaaccgctgacggtcacggcggtggagaagtcccgtggatagcccttgcgttccatttccggaatcagcaccgaacccaccgacgcggtgtcggccaccgacgaaccggagatcgcgccgaaaaaggtcgaagcgacgatgttgaccagcgacagaccgccgcggacaaaccccaccagcaccccggcacacgccaccaatcgacgggacatgccaccctcggccatgatcgcaccggcgagtacgaagaacggaatggccagcagcgagaatttgttcacccccgaagcgacctggatcatcaccgcctggaacggaatgtcgatccaccatgcaccgatcagcgcggccgcgccgagcgcgtaggcgaccggcatgccgatcaggatcaatacgataaaactgcccagcagtatcagagcgtccattaagcggcaccttcactttcttcaaccaggtcgaactgcacgacgcgtcgtttgctctggtcaccgagcaagagtttttccacaacgaaaatcagcgttagcaagccgcccagtggaatcggcaaataggtcacgccaacccgcaggtcgggcagggcggccatgaactggttccaggtggacatgcacagtttggcgccccagatcgtcatgaaaatgcagatcgccgccatgagtaactgggaaaaaatcgccgctgcggatttcagttgcggcggcatgcggtcggtgagcatcgccaccgccatgtgcgcgccagcgcgataactggcggcagcgccgataaaagtgaacaccatcatcagcagaatcgctgtgggttccggccagctcgagccggtgcccaggacgtagcgggcaaacacgccccaagggatcatcagggaaatcgccaggacggaaaggccggcgacccagatgcacgtcatgtaaatcttgtcgttgatacgcagcagcaaattcttcatcgggttccaccgtaaccggacgcgcctcaaacatcgggcgcgtcgggccttttcatgagtatggagtgggaggcgttactgaacggcttcgatctttttgatcagatcggcatacggcgcgccgtatttctcccgaaccgaggcggtggcgtcgtagaagggtttcttgtcgacggtgatgaactcgacgccggcagccttgagtttttcttcgctggcagcggatttcttgtcccacagcacgcgttcttcagcctgggcagccttggcggctgtcttgaccagcgcctgttgatccggggtgagtttttcccaagtgattttcgacatcacgatcggctcgggcaggatcaggtgaccggtcaggctatagaatttggcgttctggaagtggttgtgttcaagcagggtcggcgggttgttttccgcgccgtcgatcacgccggtctgcagggcgctgaagatctcgccggtgtccatggcgatgccgttaccgcccatggcgttcatcatgtcgatgaacatcgggttgccctggacacggattttcatgcctttgaggtcttcgagtttgcgtaccggtttcttggtgtaaatgctgcgtgtgccgccgtccatccacgccagggccaccaggccgaattcggagttggtgattttgccgaggatttcgtcgcctaccgggccatcgatgacgtcacgcatgtgtttctggtcgcggaagatgaacggcatgttgaacacgttcacgtccggcaccactgggccgacgatacccaggctgacgcgcgacagctgcaccgcgccgacctgcatctgctcgatgacttccttttccgaaccgagcacaccgccggggaagtacttgaaggtcagctcgccgttggattctttggtcagggtcttgcccatgctttcttcggctacgacggtcgggtaaccggcggggtgaatgtcagcgaatttgagttccagcgcctgagcggcaccggcaaaggtgaacatcagtggaagtgcagcggcgagcaaggtgcgtttgaagttcatgggggtgagtctccagtcttgttattgttgtgttcaaggcgcagcggtgcagcagagggtttaaagccaatcgttgaacaagggttccggaaggcctttgacgcctggcttcaaggcgaacacgccgccggccagagattgcggatcgtggtcatcgccgggacggatcgaggcgacgaacaaggtgtccatcccgctgccaccgaaggcgcacatggtgggttttttcaccggtacgggcagcgagtagtcaaggcgcccatccggcgtgaagcgatggacgaggccggcgtcgttggcgcagatccagtagcaaccttcggcgtccacggcggcgccatcggggcgaccggggaaattgttcatgtcgacgaagacgcgtcggttcgacggtgtgccagtgtccgtgtcgtaatcgaacgcccagatcagttgcacgtcgggatgcgaatcggacaggtacatcgtcttgccgtcggggctgaaaccgaggccgttgggcacgatgaagccgtcgagttgcgcttcgaccaccccagactgcccggcgccgtaacgatagagccggccttcgggagcattcaggcccatgttcaacaccatgctgccagcccagaaccggccctgacggtcgcagcgaccatcgttcagacgcatgtcttggcggctgtgctcgacgctggccaacaactcactgtcgaggctgccgtcgctgtgcgggtgcagatggaagaatccgctttccatgccggccacccagccgccacggctgtggcgggcaatgcaggcgagcatttgcggggctttccaggcatgcacatgcccagtgtcggcgctccagcgttgcaggccgccgttgggaatatccacccagtacagcgcattttcctctgccacccagaccgggctttcgcctacggcgttgcgggcatcgacgatcaattcggcttgcatactcattcctttgcgtcgttatcagagtgatcagtcgccgaacggacctgccgcgacaaaggcgccgccctgatagatccgcgccgggtcatcggcggccggcatgggttgcgcttcgactttttcacggaacacttccgagctgtccttcgcttcgaaaccgaggtggctggcgaagcggttgtcccaccagacgtccttgttgtcggacatgccgtagacaatcgtgtgaccgacgttcggcgtgtacagcgagtgttcgagcaattgcgtgaggtcgtcgaagctcagccaggtgtgcatcattcgacggttttgcggctcggggaacgaggagccgatgcggatgctgacggtctcgatgccgtagcgatcgaagtagaaactggccatgtcttcgccgtaagacttggacaatccgtagtagccatcggggcggcgggcggagctggcatcgagcggctcgtactgtttatagaagccgatcacatggttggagctggcgaagatcacccgcttcacgccatgtcggcgcgcggcttcatagatgtgaaagacgccgcaaatgttagcgccgaggatttcttcgaacgggcgctcaacggagacgccaccaaagtgcaggattgcatcgacgccttcgaccaattggtgcacggcgtgtttgtcggcgaggtcgcagacgacgatttcttcgcgctcatcgctagccggagcgagggcggcgatgtcggacagacgcagcacattggcataagggcgcaggcgttcgcgcagaactttgcccaggccaccggcagcgccggtcagcagcaggcgattgaatggagcgcggggagtagaggtagacgtcatggcaatccctggacatattgttattagggttgttgtaggttgtcgtatgactgcgctgaagtatcggtagggtttccggaacttgtcaacgcgacttttggtgtagatgacggaaggcccggttgtcttttcgatcaccaccgttccgtatttgcaatgcaatcccatgtgggagcgagcctgctcgcgaaagcggtgtgtcaatcaacatcaatggtgaatctgccgccgccatcgctggcaagccagctcccacaggtatcagcgttgttttcaattactgcattcaccacaaaatcctgtgggagctggcttgccagcgatgaggccggtccaggcaacacttgcatcgactgacacgccgccttcgggagcaggctcgctcccacagggaaactcggtgtggcgactggctttacaacaacgaaatcggataactgataaagatccggttctcatcaaactcgttggtgctgaagtcccggcgaatcgttgcgttacgccatttcacgttgagattcttcagcggcccgctctgcacggtgtaggccagttccgactcgcggccccattccttgccgtcagtaattgttccggtatgcacgttatcgccgctgatgtagcggttcatcagggtcagaccgggaacgccgagggcgacgaagttgtagtcgtgacgcaactgccacgagcgttccttggcgttgtcgtaactggcgttgtaactgtcgttggcgagggtgccgccgctggtgccgttgacccgcatccacgcgtcgtcgccgctgagtttttgcaggccgacgtagaaggtgttgccaccgtatttggccgaaagcagggcgaacgcggtcttgttgtcgaggtcgccggcctgggcgctgccgtcttccttgccggtgaagaaaccgaggttggcgcccagggtccagtcgcccaacggctggctgtggctgaggttgaaatactgctgttggtagatgtcgctgagttcggcgtaccacacgccgaccagggtgcgcttgtcgttgaaggtgtattcgccgccgccgaagttgaagcggtcggaagtgaacgcgccgcggccattcatcgacatgtcttccatgctcgcgtcgttgcgtgggctgttgccgcggaactggccgccgtagacgctcaggccattgatctcggtggaggtgatctggccgccgcgaaaggtctgcggcagggagcggccatcgtcggagcgcaggatcggcagcaccggcatccattcgccaaccttcaattctgtcttcgagaccttggctttcaacgccacgccgaggcggccgaaattatccgccggacgcccgtcatcgtggatcggcaacagttgcgtgccgccggtgcctttgccgccatcgagtttttgcgaatacatccccagcacatcgaggccgaaaccgacggtgccttgggtgaagccggatttggcgtcgaggatgaagttctgcgtccactcttcggccttgccctgggcattggccgggttgacgaagttgcggttgaagtaggcgttgcgcaggttcagcgtggctttgctgtcttcgagaaaaccttcggcttcggcactcatcggtagggcgagggccaggctgctgcagccgatcaggctcagggtggaacggttggagaagcgagttgggcggacggaattgcggacaagtgtgctcactgtgacgctccctgtttcgtttgttgtttttattatttgtcatgcgtcgtcgtacaacatgggtgcggatatttcctaggttttgcgggaatgtcaacagcaagttatacgatgacttcctgccatcacccagatccctcgtgggagcgagcctgctcgcgaatgcggactttcatccgacaacgttgtcgactgacacaccgctttcgcgagcaggctcgctcccacaggggaaaagtgttttagcaatgaatttgcggcaaacttcatccactctctatacaaggccttgcaatggaccaatacgccccgcgcaactggcagccccacgaaaagcccagtctgcccggttccccctcgacgccgttgcactccaatcccaagcgcctggcctatgcgctggtcggtgtgctggtggcattgaccggtggtttgggtaattcgctggtggtcgccaacctgacgtatctgcagggcgccctcggcgcaaccaccgcagaaatggcctggctgccggcggcgtatgtgatgaccaacgtgtcgatgaacctgctgttggtgaagtttcgccagcagttcggtttgcgcgcattcactgaagtgttcctggtgctgtatgcgctggtgaccttcggccatctgttcgtcaacgatctgaattccgccgtcgcagtgcgtgcggcgcacggcatggtgggcgcggcgctgagttcgctgggcctgtattacatggtccaggcattcccggcgaagtggcggatgaaggcgctggtgctgggtcttggcacctcgcaactggcgttgccgctggcgcgcttgttctccgaagacttgttgcagattgccgagtggcgtggcttgtacctgttcgaattgggcatggcgctgctgtcgctcggttgcgtgttgatgctcaagttgccgccgggcgatcgtttcaaaaccttcgaaaaactcgattttctgaccttcgcgattctcgctacgggcgtggcgttgttgtgcgcggtgctgtcgctggggcggattgactggtggctggaggcggactggatcggtgttgccctggcttcgtccatcgcgctgattctcgccggcctggccatcgaacataaccgtagcaacccgatgctgatgacccgttggcttggcagcggaacgatgatccgcctggcgctggcggtgaccctgattcgtatggtcacctcggagcagtccaccggggcggtgggcttcatgcaaaacctgaacatgggctacgagcagttgcacagcctgtacgtggtcatgctgattggcagcgtcgcggggctgttgaccagtgcactgacgatcgaccccaaacacctgttgatgccgttgatcatctccctgggtctgatggccaccgggtcggtgatggacagtttttccaacaacctgacccgcccgcagaacctgtatttcagccagttcctgctggccttcggcagcacgtttttcctcggcccgaccatggttctcggcacgcgcaacgtgctgaccaatccgcgtaacctggtgagtttttccgtgctgttcgggatctgcaataaccttggcggcctgcttggcgcagcgcttctgggaactttccagatcgtccgggaaaaatttcattccagtcaaatcgttgagcatctgacgctgtctgaccctttagtggcagcacgcgtgcagagcggcggctcggcgtacggttcgctgttggccgatccgagcctgcgcaatctcgcgggtattcgcaccctgtccaatgccgctacccgtgaggccaacgtgctggcctataacgacgtgttcatgctgatcgccgtgattgcggtgctgaccatgatctggctgtccattcgtgcgctgtggctgatgagcaccaccaaagccgtcgcccctgcgccatccacaccttcgagcggtgccacttcttcatgaccgaaccgaccaccacgaccaccaatgccattgccgcgacgcccgagggtgtggcgccgccgtcatcgccgaacaccgagccacgttcgctgcgagtgcggatcatctcttcgctgggcttcgccgcgattgctatcgttggcgtgctgatcgtgctttatgcctggcaattgccgccgttcagcagcgcggtcgagaccacggaaaacgcactggtgcgcgggcaggtaacgatcatcggcccgcagctcgccggctatgtctatgaagtgccggtgcaggatttccagtacgtgaaggccggggatttgctggtgcgtctggacgaccgcatttatcagcagcgcctcgatcagtcgttggcgcaactggcggtgcaaaaggcttccctggccaacgtggtgcagcaacgcaacagcgccgaggcgacgataaaattgcgtcaggccgtgcaggccgacagcgaagcgcaattgcgcaaaagcgaggccgatctgcgccgaaatcaggaattggtgcgcgacggttcagtgtccaagcgtgagatggatgtggcactcgcggccaatgcgcaaagcattgcggcggtggcgcaagccaaggccaatctggaaatcgcccggcaggatctgcaaacggtgatcgtcaatcgcggctcgctggaggcggcggtggccagcgccgaagcggcggtgcaactggcgcggatcgatctgtcgaacacgcgcatcgtcgccccgcgtgacggtcagctcgggcagatcggcgtacgccttggcgcctacgtcaactccggggcgcagttgatggcgttggtgccgaaccagaaatgggtgatcgccaacatgaaggagacccagatggacaacgtgcgggtcgggcaaccggtgcgcttcaccgtcgatgcgttgaaccaccgtaaattcaccgggcatgtgcagcatatttcgccgggcacggggtcggaatttgccttgttgcaggcggataacgccaccggcaactttgtgaaaattgcccagcgggtgccggtgcggatcactattgatcctgatcagcaggaagaggaacggttgcggccggggatgtcggtggtggtcagcatcgataccgcagcgggcaacacccagccccattaagatcaaaagatcgcagccttcggcagctcctacatggatcatctgtaggagctgccgaaggctgcgatcttttgattttcaggcagtgatcatcgggggcagggtgccgagtagcgagacggcggctacggcgccaatgccgagcaaccattcaagcatcacgctgcgtcgcagggtgcccattcgttgttcgcagtcatcgatgcgcaagcggttgaacaatgccaacccgagcatcgccagcacaatcattgccttgatcagcagaatcaaggcaaacccgctgaacaacggcgtcggccaccactggccggtcaacacgcgcacgttgatcaaaccggtgatcagcagcccggcgaccagcgcataaccgaccccgctgaaacgccgcaaaatcgccggcattggctccgtcggctgacgcagaatcagcaccagcaacaacagtccgccgagccacgcggccacgcaggtcagatgcacgatctggttgagaatcagcaattgcccactcagcccgtcgagcatcgccccatgcccgaccggtgccagggtcgccagcagcaacgcgctcaagcccaatcgcaatggcgtgcttgaacgccaaggtgtgaacagcaacgccaacagcacagcattgatcagcagatgccaacgccacacctgaccaaaaaacgtgtggcccagtaccagcgaaactgtgtccggatcaaacgccgccgctgccgaaccggccatgctcgcggtgatcaacagcgcccaggcaatcccgctgagcagcgccacagcagccagccaacgcgccagtcgcgccaggtgccgatccacttgcggcgcttcatccttgagcagcaacggcctgaacagccaggccccgaacagcatcaacaccacgatgaaatgcacaaagcggcacagcaccagcgcttcactcatgaattactggccaaccttgaactgataagcgccttcgcttttgtgcgtatcgaccgacaccgcgtgccattcgactttgtattcgccagcgctcagcggtgcggccggggtgacgatcagggttttcttgtcgccttcggtggtcagcggcttgatcgcgaccggcgcgccatccttggtcacggtgactttggtgaaactggcctcgacaccttcggaaaaggtcaggcgcaaatcggccggggcggcgacggtgctgtcggcggccggggtctggcttttcaggtgagcgtgggcgaataccgaggatgcggcgaacagcgaagcgagcagggcagtggtggtcaagacgttcttgaacagcatcgtagatacctctgagacaggatcgaagagcctcagtttagccatccagccgcgtcagtacgaagttttgtttacagcgttagcccgcgcaccagagcggatgctagtcttgggcaacgctgttgtcagggagccctcatgggcaatcacaagatcgagattcgtcgcagtaacgtcgaaaaaatcctcctggcggcggagaaagtcttcgccgaaaaaggctttggtggcaccgccatggcggatattgccgccgaggtgcaactgccgcgttccaacctgcattactacttcagcaccaagagcgagctgtacagcgcggtgctgtttgatctgctggaagtgtggaaacaggacgcgctgtgcttcgagatgttcgacgacccgcgcgtggtgctcagcagttacatccgcgccaagatgaaccactcgcgcagccgcccgtacggctcgaaagtctgggccaatgaaatcatccacggcgcaccgacgctgggcgaggcgctggatgtcagcctgtatgactgggcgaagatgaaggaggcgaagattcgccagtgggtcgaggacaagcggattctgccggtggagccttcgagtttgctgtacatgatttgggcgtcgacgcagcattacgccgactttgatcatcaggtgaatattctcaacgagcatcagccgctgtcggacatgcagtttgagcgggcggtgcagacggtgacgagtgtgatcttgcgtgggatcgggttggagccctgaagcaaaagctgaccctcaccccagccctctcccagagggagagggagccgaccgaggtgtatttagaggtacatcgacctgaaagaccgggttgattatggattcaaagcagtccttgccagttcatgcatcggttatggattcaaagcaatccttgcctatgagtcctatcgattatggattcacggcagcactatcaggtcggcggagtttcgcagcatcccccaatcagtcccctctccctctgggagagggttagggtgagggtctttcaggatcagcccccgattcagaccgcaacgtgatacggattgcgcggatcatgattccaatccagaaacggcttcccagtatccatcggcaccatctcgatacagtccgccaccggacaagtaatctggcacaaattgcagcccacacactcctcatcaatcacttcatatttatgcgtgccgtccgcctgcttcagactaccgatcgcctggtgtgacgtgtcctcgcaagcaatgtggcagcgcccgcaaccaatgcacgcgtcctgatcaatcttggcgatcacctgatagttgatgtcgaggtacttccagtccgtggtgttgcccaccgcacgcccggcaaactcggcaatattggcgtaaccctgactgtccatccaccgcgacaacccgtccttcatctcctcgacaatccggaaaccatgcagcattgccgccgtgcacacctgcaccgcaccgctgcccagcgccatgaactccgccgcatcacgccaactgccgatgccgccaatcccacagatcggcaagccttgagtctgcggatcgcgggcaatctcggcgaccatgttcagcgcaatcggcttcaccgccgagccgcaataaccgccatgcgtgcttttgctgccgacggtgggcagggcgaccatgtgttccaggtcgacgctggtgatcgagttgatcgtattgatcagcgacaccgcatcggcgccgccgcgatgggcggcgcgggcggcgacgcggatgtcggtgatgttcggcgtcagtttgacgatcaccggcagcgagcaataggtcttgcaccagcgcgtgacttgttcgacgtactccggcacctgaccaaccgccgcacccatgccacgttcaggcatgccgtgcgggcagccgaagttcagctcgataccgtcagcgccggtggcttcgaccagcggcagaatgtgtttccacgactcctcgacgcacggcaccatcagcgacacgatcaacgcgcgatccggccagtccttcttcacctgagtgatttcgcgcaggttgatttccagcgaacggtcggtgatcagctcgatgttattgatgccgagcacttcgcggttattgccgtaatgcgctgagtagcgcgaggagacgttgaccgccgccggatcctcaccgagggttttccagaccacgccaccccagcctgcttcaaaggcgcggacgacgttgtaggctttgtcagtaggcggcgcggaggccagccagaacggattcggcgccttgatgccagcgaagactatcgagagatcggccatttacgcagcctccacgttgagcatcagttgcgcgttgatcgcctcggcggcgagtttgccgtgctgtacggcttgcacggtgaggtcttgatcgaggctggtgcaatcgccgccggcatacacgccggggacgctggtgcgcaggttttcatcgacgtagatgcgttcaccctgacgcttgagctcacgggccaatgggtcagcgagggcgctgccatcgaacgcctggccgatggctttgaagatggcatcagcggccagttcgaaggtctccccggtggtttgcaggcgaccgtcgaccagatcggtacgagcgaaacgcatgccgcgcacctggccctgagcgtcgagcagcacctcttccggttgcgcccaggtcagcaggcgcacctggttggctttggcgatgtcttgctcatggccggtggcgcccatgtccgccgcgccacggcgatacaccagattcacatcacgggcgccgaggcgggccatttgcacagccatgtcgattgccgtgttgccggcgccgaggacgatgcaacgttcggccagcggcagttgcgtcagatcatcggcctgacgcagttcgcggatgtaatcggtggcagcaagcaaacccggcgcatcttcgtgtgccaggccgagttgtttgctggcattgaggccgaggccgaggaacaccgcgtcgaactgctgatgcagttcgctgagggtcagattctcgccaagcttctgcccgtggcggatttcgataccgccgatttgcaggaggaaatccagttccttttgcgcgtagtcatcgaccagtttgtacttggcgatcccgtattcattgaggccgccagccttctcccgcgcttcgaaaatcaccacgtcatgaccgtgcatggcgctgcgatgcgcacaggacaaaccggcagggccagcgccgaccacagcaatgcgtttgccggtggtggcggcgcgctggaacgggtgttcggtgaagtgtgcgttgtcgacggcatagcgctgcagcaggccgatcaacactggcgcgcattcgtgggcgttgttgcgcacgcaggcttgctgacagaggatttcggtcggacagacccgggcgcaactgccgccgaggatgttggccgaaaggattttctgcgcagcgccggggacgttgtcctgatggatattgcggatgaacgagggaatatcgatctcgctcgggcacgcattcacgcacggtgcgtcgtagcaatacaggcagcgcgaggcttccagatgcgcttgccgatcgttgagcggtggcgccagatcggtgaaatggccggcgagggcggccgcactttcgtgcgggtgggggagatggttcagggtctcgatcacggtttatggcctcacggttatttgaggtgctgcctctgatgggcagatcgttcccacgctctgcgtgggaatgcctctagggacgctccgcgtccagtgacgcggagcgtcacgggcttcattcccacgcagagcgtgggaacgatcatcttctggggatcagcgtttcacggcagtgggccggtgcatctcagcccgcttgctcagcaaatcaaacaccgccggatacgccggccgttcgatataccgcccggcaccgcgctcggcgcgcaggtcgccatcggcccagaccacgcggccctggctgacggtatggctcggcacgccaagtacggtcttgccttcgaagatgttgaagtccacctgctgatggtgggtcttggcggaaatggtgcgcgtaccctgcggatcccacagcaccagatcggcatcggcgccaacgcgaatcgcacctttgcgcggatagagattgaagattttcgcggtgttggtggaggtgagcgcgacgaaatcctgcatcgacaaacgcccggaattaaccccctcatcccaaagcaccgccatgcggtcttcaatgccggcggtgccgttgggaatcttgctgaagtcatcacggccggcggctttttgctcggcgcagaagcagcaatggtcagtcgcggtggtgtgcagattgccgttttgcagaccgtgccacagcgcttcctgatgaccgcgcgggcggaacggcgggctcatcacgtaaccggcagcggtctgccagtccgggtgttggtagacgctgtcgtcgagcagcaaatgcccggcgagcacttcgccatacaccggttggcccttgctgcgcgcataggtgatttcgtcgagggcttccttggtcgaaacgtgcaccaggtacaacggcgtgccgatggtttcagcgatacgaatcgcccgactggctgcttcaccttcaacctgcgacggccgcgacagcggatgcgcttccggcccagtgatgccctgggccatcaacttgcgttgcaggtgatagaccagctcgccgttttccgcatgcacggtcggcactgcgccgagttccaggcaacgttcgaagctcgccaccagcgtgtcgtcggcggccatgatcgcgttcttgtaggccatgaagtgcttgaagctgttgatgccgtgatggctgaccagctcggccatttcctcacgcacctgctcgctccaccaggtgatcgcgacgtggaagccatagtcggacgcggatttttctgcccagccacgccactgatgaaacgcttccatcaacgactgctgcggattgggaatcacaaagtcgatgattgatgtggtgccaccggccagtcccgccgccgtgccactgtaaaaatcttcactggccacagtgcccatgaacggaagctgcatgtgggtgtgcggatcgatgccgccgggcatcaggtattggccactgccgtcgagcacttcggcgccggcgggaatatccaggttttcaccgatggctttgatcacgccgtcggcgcaatagacgtcggcgcgataactttcatcatgggtaacaacggtggcgccacggatcaacagagacattccgagttcctcgcaggcattgaccgacttgtgccggttctagatgttttattggtgtacagcgttacaggttgtattcctgtcagcgctgtcaggaatagaagctagtcgcagatttgcaatagatcaagattattttttataagcttatgactgttttaagtgattgaaaaataaagataaaaccgattaatcaccaaaatggtgaggccgttcaccattttgacgcacttgacaggatggaaatatgagcaagattttgtatgtgaaatcagccgcttgaagttgagctgcggctgctcgcgcacattgaaaataaatgcagtgcaccagattgagtcctgacagttcgaacaacttgcccgacgtttagcctgagcgttcagacaagttttcgcggactcccaaggtgaataattaaaactgatgaatatcagaaagttgcaaagcgtttgcagtaccgcccgatgcgaaagcggggcacccggcacgtttattgatgccgccgctgacaccatggccggtgcacgaaagttgtcagttcctccggccatcgtccggtttgcacctgcgagtgccagccgcctgatgagcaaaaaaataatcagaagaacagtggagcggccatgcaacagaacagatcgcaagtgaccgagcgcgacggcttgttcgaactcgaagccggcagcgatgtcctcgacagtccccgttacaaccacgacatggcaccgaccaaggtgcgcgaacgaacctggaacaaatggcacatcaccgcgctgtgggtcggcatgtcgatctgtgtgccgacctataccctcggcggcgtgctcaccgcgtacttcggcttgagcgtcggcgaagcgctgctggcgattctgttcgccaacgtcattgtgctgattccgctcacgctgaacgcctttcccgggaccaagtacggcattccgttcccggtgctgctgcgttcatcgttcggcattctcggctccaacgtgccgtgcctgattcgcgcgttggtcgcgtgtggctggttcggcattcagacgatgtttggcgggttggcgatccacctgtttctcggctcggtgttcgagggctggaaatccctcggtggcaccggggaggtgatcggcttcatggtgttctgggcgctgaacctgtgggtggtgattcgcggcgccgagtcgatcaagtggctggagacgttatccgcgccattgctggtggcggtcggcatcggcttgctggtgtgggcgatgcccaatgtgtcgatgaccgaactgctggcgatcccgccaaaacgtccggaaggcgccagtgtggtgagttacttcgccgccgggttgacggcgatggtgggtttctgggcgacgttgtcgctgaacattccggacttcagtcgttacgccaagagccagaaggatcagatcctcgggcagattttcggcctgccgctgaccatgtttttgttcgcttcgctgggcgtaatcatgactgcggcgtcggtgaaactggtcggcgtcaccgtgtctgatccagtcagtctgatcggtcatatccagagccctgtgtgggtcgcggtggcgatggcgttgatcatcatcgccacgttgtcgaccaacaccgccgcaaacattgtctcgccgaccaacgactttcagaacatcgcgcccaaagtgatcaaccgcaccaaagcggtgttgctgaccgggttggtcgggctgttgctgatgggccatgagttgctgaaaaagcttggtttgattgtctccgatgtcagcctggaaaccgtgtattccaattggctgctcgggtattcaagcctgctcggaccgatcgccgggatcatggtggtggactatttcctgatcaagaaacagcaactcgatctggccgggttgtaccgcgatgacgtctatccggcgtggaactgggcggggtttcttgcgttcggggtgccggttgtactgaccttgttgtcgctgggcagcgatgcgttcagctggttctacagctatggctggttcaccggctcggcgctgggcgggattatttattacgggttgtgcgtgatgcgtgcgcagccctctgccgtgaaaacagcggtgtaagtcatgatcgttcccacgctctgcgtgggaatgcagcacgggacgctctgcgtcccaacagcggacgcagagcgtccatggatgagtgcccacgcagagcgtgggaactatcggtatcagcactgaggagatccccatgaacgcagccgtagacgttctgcaatcgagccatcagcacatcaaccgcgaccgcttatgggcgtcgctcatggagctggccagactcggcgccacggtcaagggcggggtctgtcgtctggccctgaccgatctcgaccgccaggcccgcgacctgtttgtgcaatggtgcaaggacgccggatgcagcgtcacggtcgatgaagtcggcaacatcttcgcccgtcgcccggggcgcaatcccgacctgccgccagtgatgaccggcagccacatcgacacccaacccaccggcggcaagttcgacggctgcttcggtgtactcgccggtgtcgaggtgctgcgtaccctcaacgacctcaaggtggaaaccgaagcgccactggaagtggtggtctggaccaacgaagaaggctcgcgctttgcgccgtgcatgatgggctccggcgtgtttgctgaaaaattcaccctcgaagaaaccctcgccaaggtcgatgccgagggcgtcacggtcggcgaagcgctgaacgccatcggctacgccggttcgcgcaaggtcagcggacataaagttggcgcttacttcgaagcgcacatagaacaaggcccgatcctcgaagacgagcagaaaaccatcggcgtggtgctcggcgcgctggggcagaagtggttcgacctcaagctgcgcggcgtcgaggctcatgccggaccaaccccgatgcacctgcgcaaagatgccttggtcggtgcctcggttgtcgtcggcgccgtcaaccgcgcagccctcggccatcaaccgcacgcctgcggcacggtcggttgcctgcaagcctatcccggctcgcgcaacgtcatccccggcgaagtgcgcatgaccctcgacttccggcatctggaaccggcgcggctgaattcgatgatcgccgaggtcaaacaagtcattgaagcgacctgtgaggaacatggactgacttatgaactgacacctaccgccgacttcccgccgctgtacttcgaaaagggttgcgtggacgcggtgcgtggcgccgcgaaaggcctgggcctgtcgcacatggacatcgtcagcggcgccggccacgacgcaatcttcctcgccgaacttggtccagcggggatgatattcgtgccatgcgaaggcggcatcagccacaacgaaatcgagaatgccgcgccggatgatctggcggcggggtgcgcggtgttgttgcgggcgatgctggcggcgtcggcggcggtggcagccggacagcgtgctgcctgaagacacggcataacctgtgggagctggcttgccagcgatggcggtggatcagtcgactctgtatcaactgaaaatccgttatcgctggcaagccagctcccacaggattcatttactcaggtgagtgaggcgatcagccggaacggtcgtttttgcttgcggcactcgtgcgccggtcattgccattcggattgccgatatccagcaagcgcctctccaccaagacattctccaacgcctgacgctcgaacggcgccatctggtgttcgcgctttttcagctccagcagaatggggctggaccaggtgcgataggtctgttcgatcgtgcgacgcgacgtcatcagtctctccttgatcaagagccctggggctcagtccgatgagggagtaacgttagtcgacaaacccggaaggcgcgaatacaccgcgatcccctttaggagtgagcctgctcgcgatagcggtctgtcagccacgttaactctgactgatacaccgctatcgcgagcaggctcactcctacaagggttttgtggtgggttttgatcagtcgtcgacgttcatcaattgctgcacgccttcccacgcttcggcgcgcatgcgttcgatgtccaggcccggaattacgccgttgtcgacgacgatccggccgcccaccaggctgtatttcaccgtgatcggttcgcccgcgaccaccggcgcgacggcgctgtcgtggaagccatagaaccgaggatgatcgaggctgtagaccaccaggtccgccgcttgcccgacttccagcgtgccgacggcgccaagccccagcacctgcgcgccgcccgccgtgccccagtgaatgacgtcttcagcggtggtcgccgaggcgccttgttcggcgcggtggatcagccacgcggtgttggcttcgccgaccatgcttccggattcgttggaggcgacaccgtcgacaccgagggagatcggcacgccggcctcgtacatttgtgggatcggcgcgacgccgctgcccagccgggcgttgctcaccgggcagtgggacacgccggtgccggtctgcgcgagcatgcggatttctcccggttgcaggtgtacggcgtgggcgaaccagacgtcggggccgagccattcgtgttcggcgacgaattccaccggcaggcagttgtatttttcccggcagaaattcacgtagttctgcgtttccgacaggtgcgtgtgcaggcgcaggccgagtccgcgcgcggtatgggcgagttcgcgcagcagggttggcggcaaggaaaaggtcggcgtggtcggggcgacgaccacgcggcgcatcgcgtctggggtgtcctggtgatacagcgctttcagccgttcgatatcgccgaccatttgttcgaggctttctggttgcagcgcagttttcgagaagccgggatgcgcgctggccgactccagcgcgccgccacggcacagcacaaagcgcaggccaaattcatcggccatgtcgaacagcaagtcgccggtctcggtgctgccgtgggcgtggtagaggtagtggtgatcggcgcaggtggtgacgccggacagcagcaactcgaccatgcccagccgtgcggcgatccgcgccagttgtggggtgaagcggttgaggcgcgggtagggcacgctcgccagccagccttgcagatcctgattcagtccttcgggcacggctttgagcaggttctggaacaggtgatggtgggtgttgatccagcctggatagaccacgctgttgcgcgcgtcgatcagccgttcgccgggttgtggttcaaggttcgcggccatttcagcgatgcgaccattgaccacgcgaatgtccacggcgccggcccgcgcgcgagggccgcgcaggccggtcatcaccgcgaccgggttcttgatcaggatgttctgaagttgagtcatgggcagctccaaactaaaggatgtgcgaggcggatttgctggcggtggtttgcgccacgctgacgccattcagcgcggcattgagcagcaccgacaccaggcaagcgataaccacgctgctgtgcaggaacggctgcgaccactcgggaagttgcttgaacaaggtgggggcgagcaccggcaccagcgcggcggcgagggtgaagccgacgatcagcacgttgtagcgattgcgctcgtaatcgactttggcgagggtttgaatgcccgccgccgcgaccacgccgaacatggcaataccggcaccaccgagggcggcggtcggcatcgaggcgatgatcgcgccggccttcggcaccaaggcaatcgagcacatcagcaagccgctgaccgcgaccacccaacggctgcgcacgccggtaagaatcaccaggccgacgttttccatgaaggcgataaacgggaatgcggcgaacatgccggcgatggtgctggccaggccattggcgcgcaggccgttgatcacctgtttgtcttccaccggtttttcgacgatatcgccgatggccacaaacagccccatcgattcgaccatctgcacgatcatcaccacgaccatggtcgcgatgggaatcaggctgaaagtcggcagcccgaaatagaacgggtagggcacggtcagccacggcgcttcttcgacgctgtgaaaactgcccatgcccagaccgtacgccagaccggcgccgatcaacatgccgatcagcaccgccatattgcgcagcaacgggctgccatagcggttgaccagcagaatcgtcagcaacaccaccaccgcgacgccgagaaacgtcggggcgccgaagttgctcgcattgcgcccgccaccgacccattcataagcaatcgggaacagctgcaagccgatcaccgtgacgatgcaaccggtcaccaccggcggaaaaaatcgccgcaatcgaccgacgaacggcgccatcagcatggtgaacaatcctgcgccgatgaccgcgccgcagaccccggcgaatcccacttccgggttgctgccgatggcgatcacaggtcccacgctactgaacgccacgccttgcagaatcggcagacgcacgccgaatttccagaagccgacggtttgcagaagggtggcgatgcctgagcagaacagcgtggtgctgatcagcaccaccgtgtcggcgtgggacattttcagggcgctggcgacaatcaacggcacggcgatggcgccgatgtacgagacggccatgtgctgcaggccgagggtgagcatctgtcgcaccggcaaaacgcggtcgacggggtgcacggtggatgcggttttcgatggggatgtggctgacgacatggggaaacacctctggctgtttttatgcggtagagaggggtattcgtctgatgcctgctgcagatcccctgtaggagtgagcctgctcgcgatagcggtgaatcagtcaccatcattgctcaatgacacaccgctatcgcgaacaggctcactcctacaggttttgtggcatcagtcattcgtacacatgtgcccgaagccgccatccaccggctccgatgccttgtttcagcctgccaggcaggcggcgaagccctggtttagcgccgcgcggtccaggtcgcggccgatgaacacgatcttgctcgagcggggctccgtgccccacgcggtcgaggcgcgaaattccaccaggctgtgcacgccttgcagcacgtagcgctgatcttcgttggcgaccgcgagcacgcctttcatgcggtacaggttgtcagcctgggaggaacgcagttcgctgatccagcggtggaacgccatcaggttgaccgcgccgtccacggcgatgcccaccgatgacacgcttgggtcgtgttggtggtcctgctcttcagtagagtgctcagcgtgatgctcatggtcgtgatcatggtgatcgtgctgatccgcgccgatttccatcagcttctgcgtgcattcaaacgcgccgatgccgaggattttcgtcaggtcgatttgcgcatgggtcgaggtcaccagatccgccgtggcgttcaagccacggatcttgccgcgcagggtttcaacttctgcagggctgaccagatcgaccttgttgatgacgatccggtcggcgcaaacaatctgatccaccgcctgattgtcgacgccgtcgagttgcagatcctccagatgctgggcgatgtgtttggcgtcgaccatggtcacgatcgcgtcgagttccacttcctcggcaatcgggtcattgatgaaaaagctctgcgccaccgggtaaggatcggccagaccgctggtctcgatgaggatgtgatcgaggcgcaccgggcgcgccaccagttcgcggacgatgcgtaccaagtcctcgcgaacctcggcggtgcagcacacgcagccgttgaccatctcgtagatttcttcggtctcggaactgaggacgaggtcgccgtcaatgccgacttcaccgaattcgttttcgatcaccgcgatcttgcgaccgtggttttccttgaggatgtagttgagcagggtggttttaccggcaccgaggaaaccggtgaggatggtcacggggattttggtgttgcgggttggggcgttgaagggggtgttcatggtgaggctcctttgattgaccggtgcacactgaattcgggtggtgctgcttttctgtaggccttcgcctgctcgcgatagcggtgtatcaactgagatttacttcactgacactccgctatcgcgagcaggcgaaggcctacagggaactatgtgttcttgatctctccagcgggtggcgacgccggcatcgaggccgaacaggtcgagcacgcggccgaggctgtggtcgaccatttgcccgaggctttccgggcgggcgtagaacgccggtaccggcggggcgatgatcccgcccatctcggtaacggcggtcatgttgcgcaggtgcgcgagggtcagcggcgtttcgcgggccatcagcaccagggtgcggcgctccttgagcgtgacgtcggcggcgcggccgatcagccctgatgaggtgccggtggcaatctctgccaatgtgcgcatcgaacacggcgccaccaccatgccgaggcagcgaaacgatccgctggcgatcccggcggcgacgtcatcggcgcggtggtagtggctggccagcgcggtgacgtcggcgagtttgtagtcggtttcgtgggccatggtcagcagcgccgcgcggctgatgatcaggtggctttcgatgtccagctcggcgagcaattgcagcaagcgcacgccgtagataaacccggacgcgccgctgatgccgacgaccatccgttgccggttcacgattgcagacctttgagcaaaaccctcgcccgctcaagaacatcctgatcaagctgcgccttgatcccgtcaaatcctgaaccgcgagtcgcatccaggcccatccgcgacgtcgtgccattgaccgacgacgatggatcgagcggactaccgggcaaaccatcaatggtgaaaatatccaggtgcggctgaaagtgcgtggccagcgcccacaacacctggctgtcatcgctgatgtcgatatcgctgtccaccgcgatcacggttttcagatacggatcccagccgagcaacgccagcatgatctgccgcgcctcgccgtcacggctctgatccagcgccacatagcagtgaaaatgcgtgccggaattcgggtaatgcacagcggtgacggcggggaaacgcgccttgagtttttcgctcatctcggcttcgcggggcaggcgggcgagggtcaggtgttcggcgtagcggccgcccatcacgtcaaccagccaggcatctttgcgctttaacagggtgtcaacgcgcagcacattgttggtcgagcgatccgaggaataaccgctgaactcgccgaacggaccttcttcggcgtaggccgccgggtcgatggcgccctctaaaacaaactccgcgtacgccggtacaccgatgccgtagcgcggggttttcaccagttccagcggcgccccgaacaagccgccagcgacggcgcgttcatcgctgccatacggcaggcgtgcagcggcggcgagcatgaacagcggatgcgcaccgaccaccatggccacgcgcaattcttcgccacgttcgcgggcggtctgcagcatccgccacaggtgaccgcgtgaatgcaggctggtggcgagggcctgacgggcgtggcgcatcgagcggtggtagctcatgttggcgatgccggtcagcgggtcttcggcaacgatgaccgcgttggtgatgtacggaccgcgatcactgtcgaaatgcttgagcatcggcagcagcgcgagatccagcgcttcaccttcgaatacctcatcgaggatcgggccgctttccacataacgcggtgcgatgggctggttggcgcgggtctggaaggtttcgtgcagttgcgccggagtgacgccaaacaaccgggcgatgcgggtgcgagaggcgaacagattggtcgccaccggcacgccgaggttgccaacgttttcgcagatcagcagcggatcgcggccctgagcggcgagggcgtcgaccagggcggtgacgtcctggtcggcggaaatcggttgggtgacggtcagcacatcgtccgggtaatcacggcgataggcgtcgatgaacacgtgaaagtcctgagaatcgccgagcgtcgaacgggtcatggtgtcacctcgtaaaaagcaggcacgcaggggtgagaggcgttcgcgcagccagccgttggcctgccgggcgagcgaaacgccgggtcatcttcgtgcctgtaaagtcgctgtgtgctctgtgttgagcaccgctcccctgtaggagtgagcctgctcgcgatagcggtgtgtcagtcactatcaccgctaaatgacacaccgctatcgcgagcaggctcactcctacaatgagattggcgttagctagagataggtggtggtcaggcgtatgtcggcctcggccagatctttgggtggtggtgtcggttcgatcccgcacaaccgggcgatgttattgcccaggtaatcctcgagatgatcctcatcaatccccaaaccctgcggtgccggtgagcacaacacctcaagctccctcagccacatccccggctcattcggcggcgaatcggtgccgaacacgatcttgttgcgcggcagttccttggcgaactcgacgatccgcgactggaagcaccagcccgattcgcagtacacgttcggcgtgtccatcgccatccagaacgcttcgaacgagtagttgccgccggtctggataccgaagtggccgatgatgaaattgaccatcgggaactcgcggatgatcgggtagaacatcgtcggaatcgtgtacggaccgtcgccggtgtggatcagcacaacaatgttgtacttggcgcagaccttcatcgccggacgcagccagtcgagcgcgcgatccgggcgatagccgtgcatgttggcgtgcagcttgagcatcttgaagccgtattccttgatgtggaattccagctccgccgcaccgttttccggtccccagcgcgggttgaagttgaagttgccgatgaagcggtccgggtacttcacacagagttcggcgatgtacgacatgtagtcgcgcacgccctcgcggccgcggcggttgccgtcgcgatagccggtgttgcctggtggcggctggatgaaacccatgtcgatgcggcgtggtttgccgttgatcatgtacgggccgtccatcagcttgagcatgcgctcgccggtgaatggttcgccagtgtggcgccaggcctcgtcgaccaggttggtggggtgcagatgggtgtcgatgatcatcggttcagctcctggccagttgagtagtgacgggacgcttgagttgcgcctctgcttcggaaacggaacgtggtggcggggtcggttcgaggccgatcatccgcgcggtgttgttgcccaagtagtcttcgagggtgtcctcgtcgaggttcaggccttgtggcggctcgtgacagagcacttcgagcaggcgcaaccacatgcccggttcgttcgggggcgtgtcggtgccgaagagaattttgtgcgtcggcagaaccttggcgaattcgacgatccgcgattgcaggcaccagccggattcgcagtagacgttgggcaactccatcgcccattgcatcggttcgaacacgtagacgccgccggtctgcacgccgaagtgggccatgatgaaattgacgttggggaattccttgatcatcggcacccattccgacgggatgctgtaaggcccgtcgccggtgtgcagcttgaccggaatgcccagctcggcgcatttctcgaagcatgggcgcacccagtcgagtgcgcggtcaggacggtaggcatgcatgttggcctgcatctgcaccatgccgaaaccgtgttccttgacgtagcgctcgatcgcttcgacgccgttttccacgccgcagcgcgggttgtagacgaagcagccgatgaagcgatccgggtaggtctggaccattttcagggtgtaggccatgtaggcgtcgatggattcacggccggtcaggtcgccgtcggtccaggtgtaaatcgtgttgccttgcggtggctggatgaaggctttgtcgatacggcgcggcttgccgttgaccatgtacgggccatccatcatctccagcagacgctcgccggtgaacgggtcaccgtcatgcctccaggcgaggtccacgagatccgtgggatagcagctgatatcgatgatcattgcagtcgatctcctgatagcggggaagggagccttgcggctctcggcatccacgtcccgggcaatcggccgttgctatgcgcaggattcgcgcattccctcgcctgttcgcatccggcccgggtgggtggctgctgagggcgagtattggaaaggggggaggggttcgtacaatattaattgggcggggtggtgatatgcgttcgatatgggcagatcaggagctaccctcaccccagccctctcccggagggagagggggccgaccgaggtgtttttcgcgatgcatcgacctgaaagttcgagtcgattatggattcaaagctgatctctcaagtcggcgtaagtcgtcaatatcccacgatcagtcccctctacctttgggcggtccgacgtttcgggagggctagggtgagggctggatttcaagtgtccgcagggccaacagtttgatcgcttcaaccaccggcgccacacgctccgcctgcccaggcggccacaccgcgtaaaggttgtaatgcgcggcaatctgcgcctcgttcaacgccaccaagcgcccactgcgcagcgcatcagccgccagtaatccacgcaccaaccccgcgccaacgccagcttctgcagcggcgataaggttggccgcgttatcaaaaatcacccgcgccggtggttcgctcggggtcatgccggcggcatccagccacggaatccacgagcgccgcgtataccccaacaacggtaattggagaatctgcgccgggctcaacggcacctgcaaaccatagcgttccagcagatcaggcgaagccacggccagcacccgatcgccacaaatctgcgtcatctcgcagtcgtcccaatcgccatagccatagcgcaacgccagatccacgcgctcgaacgtgctgcgatcactgcgcggcatcgacagcaacgtcacctcgtaatccggcaggccatcgagcaactgcggcagacgtggattgagccagctctgcgccagttcgctgtcgacatcgagcgtcaaccgttgcgcgacgctgcggtttttcaccgacgagatcgcccgatcaatctgcgccagaccgtccgacaagacactggcaaacaactgcccggcatcggtcaggttgctgccaccaccctcacgcacgaacaacggctggccaatgaaatcttccagcgcacgaatctgctggctgatcgcgctgtgggtcagatcgagtttgcgcgcagcgctggagaaactgccgctgcgcgcggcgtggataaacgcgctcatggactgcaccgacgggtatcgcttgtacatgttgttagtcctgcttacagcggttggcagaaatcgtcgctggccgggttttgctcggggttccaataatcggtcaccaggcccgcacaaagacgggccgctcttttggagcctgacaatgattgcattcacggttaacggcgaacgacgcgagctggatgaagcgtcctcctccatgcccttgttatgggtactgcgtgatcaactgaaactcaccggcaccaagttcggttgcggtatgggcctgtgcggtgcctgcaccgtgcacctggacggcgttgcggtgcgatcctgccaattgccggcggccgccgtcgcgggccacagcatcaccaccatcgaaggcttgtcgccaacgcaaaaccatccgttgcaactggcctgggtcgccgaagatgtgccgcaatgcggctactgtcaatccgggcagatcatgtccgccgccgcgctgctcaacaccggtgcggcggtgaccgacgattcgatccgcaatgcgatgtccggaaatatctgccgctgcggcacttacggacgtatcaacaaagcgatcaaacgtgcggcgaatgcgccgaaggaggcgtgatgagccccattgacgacagccgcattgaactgccgcgccgggtttttctcaagcaagcggcgaccatcgcttcaggtttggcaattgccctgtatctgccgagcgcaatagcggcgactgacccgaaagccccggctccggccagcgagttcgaaccgaatgcctgggtgcggatctttcccgacggcacggtgaaactggtggtgcacaagcacgattccggcaccggcacgcacaccgcgctggccgcgtgcgtggcggaagaattggacgtcaacccgctgaccgtgcaggtgatcaccccggaagatccgttcttcgaaacctacattcatccggtctggaaagtcttctccaccggcggcagcaccagcgtttctctggaatacgatcgcctgcgcatggccggcgccacggcgcgggcgctattgatcaccgctgccgcgaaacagtggaaagtcagccccgacagttgcaccaccgaggaaggtcgagtgatgcacacggcgagcaagcgcagcctcggttatggcgaactggtcggcgtcgcggcgaatctgcccgcgccgaccaacgtcacgctgaaggatccggcgcagttcaagtacatcggcaaactgcggcataaacgcgatgcagcggccaaggtctgcgggcgtttcaagtacagcatcgacgtgcaattgccgggcatgctggtggcggtgatcctgcgtgcgccggtggtcggggcgaaggttgtcagcgtcgattcggcggcggccctgcaagtgccgggcgtgcgtaaagtgctggcgattccgggccgccccgatgtgctcggcggcaatctggaaggcgtcgcggtactggcggacacgttctgggccgcgcagcagggccgcaaagcgcttgagatccagtggagtgactcgccgctggccgggttcgacagcgagcagctattcagcgctcaagccaaggccatcggcgatccgacagcgcaaaccgtcaaagccatgacccaaggtgatgtcgccgggcaatgggcgggcgcggcgcagctgatcgaagccgattacaccatgccgtacaaggtgcaaaacccgctggaaccgatctgcatcaccgcgcaggtcaaggacaaggcgatcactttttggggcggcgtgcaggtgccgtcctcggcgctggaagcggcgcaaaccgtatgcgggatcgacaaggccaacgtgaccattcatgagttggtctctggcggcagtttcggtgcgcgggaggccaaatactggttgttcgaagtcgcgtatctggcgcagaaaaccggcgtgccggtgaaactgctcaacagccgtgaagatgaaatgcacgcgctgttctatcatccggcgacgctgcatcgggtcaaaggcgcgctcgacgcccaaggcaaactcagcgcgctgcaactgcacgcggtgtcgccggcctcgccggagcagtgggaaccggggtacttcgaacgtccagacaagatggattacagcaccaccgaagcgatcaccgcgtgggacttcgcctatcgcccgccgcatctgcagctgaactgggtcaagcacgaaagcaacgtgccaagcggctggtatcgttcggtgagctttatccccaacgtgtttgccgtcgagagcttcatggatgagctggcgcatgcggccggtgcagatccattggcgttcaggctggccaacatgcaggaaagaccccgccatgtggcggtactcaaacaggccgccgaacgtgccggttggggtaaaccattgccgccgggcacagcgctggggatcgcgaccaatcagggctacaccagtttcatcgcggtggtcgcgcgcgtggcgacggttgacggcaagccgaaagtcgagaagctcacctgcgtggtcgattgcggtttggcggtgtcgcccggcggcgttgaagagcagatatacggcggtttgatgtggggtttcggccacgcgttgttcgatcggctcgacatcaaacagggccgggtagtgcagagcaatttccacgactatcgcgtcacgcgcatgtccgacatgccggccaccgacatcctcgtgctcgacggtgagccgagcaaacccggtggtgtcggcgaattgggcagcccttcggtggtgccggccatcgccaatgcgttgttcgcgctgaccggcgtgcgccagcgttcgacgccactgagcctgggataaatcgccatggacttgcgcctgctgcggtacttcatggcgttggccgatgagctgcacttcggtcgagccgccgaacgcctgcacatctgccagccaccgctgagccagcagattcgtttgctggaggaagaactcggcacgccgctgttcgagcgcagccatcatcgggttgaactgaccgcagcggggcagatgctcaaggagcaggcgccgctggtgttcgaacagctcgaacgggcgctggacctgacgcgacagaccgggcgcgggcaattgggcgagctggaaatcggcatgatcagttcggtgatggtcggcgtgctgccgcgagccttgcacctgtttcgcgagcgctacccgcaggtcaactggcgcttgcacgagatgaccccggcagcgcaggtcaaggcgttgaaggagaaacgtatcgatgcctgcgtgtttcgcgtcggctatgacgacccgttgttgcgcaatgagttgctgatctacgagccaattcatgtggtgatgccgacggaccatccgctggcgcagcgcgaggtgctggccccggcggatctggcgcaggagccgtttgtggcgctggaattgaagcagtcgcggttcgccaattttctctatcagtgctgcattcaggccgggttcacgccgcagatccgtcagcaggtgatcgaggtacagaccttgctcagcctggtgcgcgccgggtttggcgtggcgctgttgccggcgtccatcgagcaattggcgccggcggggctggtgtttcggcggctgacgccggcgttgccggaggtgccgttgtatgccacttatcgcgccgacgatgcttcgccagtgctcaagctgtttcttgacacgctacgggaactcaagacgcaaaattcgaactgaaatccaatcccttgtaggagtgagcctgctcgcgatagcgatgtgtcattcaacggctctgctggctgacacaccgctatcgcgagcaggctcactcctacaaagggatttgtgccgttgcgaacatttatgctcggcacgatcagagggcgctgcggtcgtactcttcacatgggcgtatcacttgtggagatccaatgagccaggaagtcctgaccaccgaaaccaaccgccgccagttgcagcagatcatcgccgggctgtccgacggggtgattctgctggagctggatcagagcattctctgggccaacgaagccgcgctgtccatgcacggtgtcggccggatcaccgatctgggccacaatgccgacgaatacgccaagaaattcaacttgcgctatcgcaataatcactcgatcaccgccgaaaactacccgatcagccgggtagcgcgctgtgagagtttcaatgacgtactgatcgaagtgtcgccggccgatgatccggaacgtatctgggtgcacagtgtgcgcagcatgatcctcaccgatcgcgaagggcagcccgaatcgctggtgctgatcatgagcgacgtcaccgactgggccaacgctgagcaacgcttcgaaaagactttcaacgccaacccggcgccggcggtgatttgccgtctcagcgacctgcgctacatcaaggtcaatctcggctttctcgaaatgaccggctatacccgcgaacaagtgatcggcacctcggcctatgagatcgacatcttcgaacaggccgagaaaaaggatctggcgattcagcgtctgcgcgatattgcgaccattccgcagatgcagtccgaattgcgcctgcctgatggcggcagcaagcaagtgatcgtggccggccagccgctgacgctcaacgatgaggattgcatgctgttttccttcgtcgacatggagccgaggcacaaggccgaggtggcgctgcgtcagagcgaggagcgttttgccaaggcctttcgcctgacgccggtgccgatcctgatttgcagtgccgatgagcagcaggtgatcgacgtcaatcaggcctttctcgaaactctggcctacgacagcgaagacgtgctcggcaaaaccgtgacgcagctggatttcatcgatgacagcggtgcgcgcacgcgtttgctgaccgctctggcgaaaaacggtcgagtggatcgggtggacgtgcgggtgcgcaagaaggattcggaactgcttgagtgtgcgctgtcggccgataccgtgaatattcaggacacaccgtgttatttgctggtgttgatggacatcaccgagcgcaaacgcaccgagcttgaactggtggcggcgattgaagaggtgatgaaggatgcttcctggttcagtcgtacgctgatcgagaagctggccaatgtgaagaaggtcaattcgccgcaactgccaagcgtgtcgttcaccgatctgacggcgcgtgagcgcgatgtgctggggttgatctgtgaagggctggcggacaaggagatcgcggcgcggctgaaactggcgccgaataccgtgcgtaatcatgtggccacggtgtattccaagctggatgtgcacagccgcagtgaggcgattgtctgggcgcgggagcgtggtttgttttctggggagccgggtggcaaggggcagcgatagggtgcaaatgcactagttgatctggtgcattttgaggtgttggtgtcgggtggctgttcttagtctgttggggtgcggcgcgagccttttgaggtttgtggtcgcgtcccttcgaagttgctaaaggaaccgccgtaatgatgaatcttgcgcagttacgcgcacagcttgagcgcagtttttcgccgctggcatgtgaatgtctggtggatggtgatcattcgctgaccgtgaagttatatcacccagtgtcggggcaggtggatctggtgatcagtgggctgaaactcgatgcgctgcgcacgccggagtcggtggaggcgttgatcgacgaattacgctacgagctcgaaagcaactccctgcgctcctcacgggaccccgacctggcataacccgtgtacgcgctgcccgtgaaagcagcggcgtgcgtaaaatcgacagccctggcaggctgatcaggcgtctttactggcgcttgcggtgacctcggctataaagaatgagtggtcaggtcttgcgtggccggtcggggcgcgcaagtaggtcttcaatttaccgcgggtcgtcctatgaacaatcctgggaatcgcgtgttgccgttggctttttttgccgtgctgctggcaggctgtgccagtccgccgccaccgccacccgtcacgccacctccaccgccggaacgtacttgccaggttctcgaaaatactgaggtcgccggcgacatgtacgtcgacgggcaagtgactcgacacatcaccaccacccgttgcgtcactcagtaacgtcggcggagcaaaagtcccgggttgagcggatcgtgctgatcgccgatctgctcggcacggcagtgtttgctgtggagggggccattgcggcgttgctggcaggcgcagcgtgtttgctgctgcgcctgttgtcagtgcattttggctggcagttgccgaaagtcatgggtgcctgaagcttaaacttcttcgagcctgacccagcgccgctcgtgtgcggcgaggcgaattgccgtggccagacgctcgaccgcccaggcctgttcgaagtcggtgccaccctgatgggagccggccagtgccatcaataggtcatgtacctctagcgtcttcagttcgttgtagcccagttggtggcccggggccgggctgaaggcggcgtagcccggcaggtcaggaccggcaagcaggcgctggaaaccgtcttgtccggcgcggaacagacgcagttcgttcaaacgctcctgatcgaacgtcagggtgccgcgcgtgccgctgatttcaaaactcaggtgattcttgtagccatgtttgagccaactgctgctgaacgtgccgcgtgcgccgttggcgaaacgcagcaaggcatgtacctgatcgtcgacgttgatcggtttttgcgtggtcccggccgggcgttgggtatgcacggtctgggtgtcggcgcagacggcttcgatgtcgcccagcagatagcgcgccattgccagcaggtgactgccgagatcggccaatgcgccgccagcatggtccgggtcgcagcgccatgaccacggcgagtcggggttggccatgaagtcttcgctgaactcgccctgaaagctgatgatctcgccgagttcgccgtcgcgtatcaagtcgtgcgcgagggtgatcatcggattgtgctgatagttgtagccgacccgggtgactacgccggcgtctctggcggcttggcacatcgcgctggcttgttcgagattcaccgccaggggtttttcgcagtacaccgctttgccggcagccagggcggccatggccatcgggtagtgcaggtgattaggggtagtgatggcgaccagattgaccttgggatcaccgatcaattgttgccagtcgctgtgatggccggcaaaaccccaggcttcggcacagtggcgggcacgctgcgggtcggcgtcggcgagggcggcgagggtgagtctgaacggcagttcgaacactgcactgacattgcgaaacgccaaggcatgggcacgccccatgaaacctgtgccgatgagaccgataccgagttcgcgcatagccgtcttcctttggatttttattttcaggaaggctatttatggaataaaaattccgttaatgcaaatgtcagaataaatattcaggccgtgcaggggctgccgaaggctgcaatccttgatcttgtctctaacaacaaaatcaaaagatcgcagccgtcggcagctcgtgcatgggtcagtcgtgatccgcgatcagcacatggggtggcaggaggtcaggagaggaaaccgccgtccacgttcagcgctacgccggtggtgtagctcgatgcatcactggccagatacaacacggcgccagccatttcacttggatcggccacgcgcttgagcgggatctgcgtcagcgcctgcttgaggatcgcatcgttctttaccagtgccgaggcgaatttggtgtcggtcaggcccggcaacagggcattgcaacggatgccgaactgcgcgcattccttggcgaaaactttggtcatgttgattaccgccgctttggtcaccgagtagatgccctggaaaatccccggcgaaatgccgttgatcgacgcgacgttgatgatgctgccgccaccgttttcgcgcatcagcttgccggcttcgaccgacatgaagaagtagccgcgaatgtttacgtcaacggtcttctggaacgcgctcaggtcagtatccagcacgttgcagaactgtgggttggtcgcggcgttgttgaccagaatgtcgaggcggccgaactgttccttgatcccggcgaatacttgggcaatctgctccatttcaccgatgtggcaagccacggctgtggctttgccgccagcggcgatgatcgcgtcggcgacgtgctggcagccatcgagtttgcggctcgaaacgatcacgtgggcgccttgctgggccagcagtttggcgatggcttcaccgatgccacggctggcgccggaaacgaaagcgattttgccgtcgaggtcgaacaactgagtcttggacataggggttccttggtgtgggccgtcagaggctcgatttcgcgatgacttgcaggctcatctgctccagcagtttgttcatgtgaatgaactgcgcgaagcgtttgtcctgggtctggccgtgatagaagcggtagtagatctgctgcacgatgccagccagacgaaacaggccgtaggtgtagtagaagtcgaaattgtcgatctggatgcccgagcgttcggcgtagtaatcgacgaactcgcggcgcgtgagcatacccggcgcatggctcggctggcggcgcatcagttgcaccggtgccgggtcatcggcctgaatccagtaggcgagggtgttgcccagatccatcagcggatcgccgagggtggtcagttcccagtcgagcacgccgatgatctgcatcgggttgtgcgggtcgaggatgacgttgtcgaagcggtagtcgttgtggacgatgctcgaggtcgggtggtcggccggcatcttgtcgttgagccaggctttgaccttttcccagtgcggcgcatcgggggtcagggctttctcatagcgctcgctccagcctttgatctggcgggcgacgtagccttccggtttgccgaggtcgccgaggccacaggcgttgtaatcgacacggtgcagttcgacgaagcggtcgatgaagctcttgcacagcgcttcggtctttgccgaatcgaggcccagttccggcggcagttccgagcgcaggatgatccctttgacccgttccatcacatagaactcggcgccgatcactgattcgtcggtgcagtgcacataagctttcgggcaatacgggaagccgtcgcgcaattgattgaggatgcggaattcgcggcccatgtcgtgggcggatttggccttgtggccgaacggcggacggcgcagaacgaattcctgctccgggtattccagcaggtaggtcaggttcgacgcaccgccgggaaactggctgatcgcaggtgtgccgctgaggccgggaatgtgcgacttgaggtacggatcgatcaggctggcatcgagttcttcgccggagcggatacgggtggactggtcagtaagcgccatgcttatcccttctgcttattttggaggccagacatcattggctaatctaatggtgcgctcgggcggtcacaagcgcggggcggtcttataggttagcgtgttgccggataatcacctttgagaatgtgcgcgaagggcagcggcagactaaggtttagcgagtatgccatggtcgaaaaggagctttgaaatgggctgcccacaagtctgtgcctcggccacgctgcagtgcagcttcggcgctgcgccgtcgatgctcaacgtgttgccggtcaaccgcacgctgaccggcgggatgccggcggcgaacatcatggatcacatcccgctggtcaacatcctgccgttcggcgtgtgcatgagcctggccaatccgatggtcgctgctgcgacggccgccgctttgggtgtgttgacgccgatgccgtgcatcccggcgacggccacaccgtggattcccggtggcgcgccgacgttgttgctgggcgggatgccggcgatcgatgccaactcgacgttgatgtgcaactgggcgggggtgatcaagattgtggtgccggggcagatgcagatgctcatcccttgagttttgtgctcggcgtgaaatccaaacccctcaccccagccctctcccagggggagagggagccgattgggggatattgatgagctacgccgacgtgaaaatctagctgtgaatccataatcgactcggtcttgcaggtcgatgtatgaagcaagacagctcggtcggtcccctctccctctgggcggtccgacgtttcgggagggctagggtgaggggctcttccggggttttcaggcctgctgcggatccgcccactgccgataccaccagcgcacccgcgaaatcggcttgccatcggcgcccagcggccgcccgtcctcggcatagccttgctccggttccatcaattgcccgttcagataacgcgcttccaccgccggtttgccattcggatgaaaacgctgataacgcccctcacgcacgccatcgcgataaaactccgcctccgccacttgcccatccgcgaagtaattgaacgcttcgccatgcagcaagcctcgccgatacgtcgccttgcgctgtaaaaaaccctccggcgcgtaaaaactcgcgaccccttgcagcttgtcgtgcacaaacggcatttgcgccgagaccttgccattggggtgatacagcagtgacgtgccctgcaactcgccctcgcggtaatgcagatcggcctgcttgcgcccgtcatccttgatgttcagcggtccatcaagctggccgtcctgcaagcggcccttgagctgcttgtcagcctgctgcagatccagcggtgtgattgccatggcttctccttgtcaattgacctgcaccagaccgcccttgatggtcagcatgccgccaccgtcgacggtctgcgaggcagcgcccttgttggtcagactgatgccggcgtcgttggtcagcgtcgtgccggccttgttgtccagcgaagttccggcctgattggtcatcgcggtgccggctttctgtgtgattgaagtgctcgccgacgtcgccagatccgcgccgctcttgatcgtgaagctgccgccactttgcagggtgagggtgccgctgaccttgatggtcaggttgccatccacggtcaggctgtaatcaccggtgaccttgtcggtgtagttgccgccggtgctgtggttctgatcagcaccgactttcaccgtacggctgtctttcacttcgaggctgtcgctgccggtctggatcgtgacgctgcgcttgcctttttccagcgtgacggtttcgtcgccgtccttcaccgtgcgcgtgcgggcgttttgtacggtgagggtttcgtcgtggccaacgatggcggtggcgtcgttgagcacgttgatgttcagatctttttgcgcctgcaagaacacttcttcggcgtctttcttgtcctcgaagcgcaattcattgaagccgccgccacccttggatgactgggtcttgattcccgattgtgtctgattggccgggagggcatagggcagggcgttgtcgccgttgtagacgcagccagtgaccagtggacgatccggatcgccgtcgataaacgtcacgatgacttcctggccgatgcgcgggatgaactgcatgccgaaccctttgccactccacggcaacaccacgcgcacccagcaggagctggtttcgtcattcttgccatcgcgatcccacgggaactgcaacttgatccggccgtattcgtcggtccagatttcttcaccggatttacccacgacgatcgctgtttgcggatgcatgcgtggtttcggcgtggtgcgctgcgggcgaaacgcggtgcttttggggatcgcttcgaagcggttgcgatagctctcgtggctggcgtcgtgagtgacgcgggtcaccacccaatcgatgttcaggctgctgtcgtcatgcccgtcgagggtgaaccaatgcccgggaatcagccagcgacagtcactctcgccaacaaaacgcttctcctcgctgcgcaagccatccacccgttgcttggtcagggtatcgccgcgcgccttggcgttgtaaccacccggatgcgcatagatcgaaagtggcccggccacggcttctgcctgtccataaagagaagttgttggggtggtgaattcataatccgtcgcccggtacactccggacacggcttgtaaactgacttggccgcaacggatgccgtgcaattctcgttcgcccaatccttgacccaggtacttgaccgtcggcccattggggatctgtacgaatgcgtcgttactgtcgccgagcaccagcgtgtgcgtgccggcgtcatgggtaaaaaaccagaaaatcccgtcctcctccaacaagcgcgagacaaaagcgaaatccgtttcaccgtactgcacgcagtactcgcgcggcgtgtaactgccggtcagcgacagcttgaagtcagtgaaaccgtaagccttgaaaatggtcgtgacgatgtccgctgtcgcgaggttctggaacactcggttgttgctggccagagtcagccaccagagccacggcctgagtacaagttgatagcgttcggccgtggcgtcggcggggagttgtcggatctcggcgaccaaggcgtcaaaggggcgttgttgggcatcgttgtgcagggtggtggtgacgtgtgtagcgacggccgaagtcagggtgaggggcgcgccgtcattgagcccgttgagggtttgcacgcccagcatattgagcgcttcgttaccggaaagggattcagggtaaagcgccgacagcgaggcggcggtgagggagagggtggtggcgctgtcggaggagcggggcatcgaaaatactcacgtgataatcaatattcagtgccaacattgaataatcaacgaactagttgattggatccgcttgatgtcgtgaaaccaagtgcgcgaacgcggttatatgttcggatgcgttgaactgctgtcgtgcttctgcgttatttatagggtccacagggccggggtgcggaaactgcaatctgaactgttgtaagatccaatcgataagcgccgccagattggacaagtcaggaactggtgctgcattcatgtcgagtaaaagcacgtctccggtaccttcctggtaactgggcatgcctgcctgggcaacagacagcactgccgcggggtaataatggaaacccgtggcgtaatagtaaatatagtgaacggcgcccactttggtagtccagaggagtttgaaaacagccgaatcgagctcaacttttctgtgggattcctcggtagcctctttggcgcaagtcacgtaagtattgtcatcatcatcgtttccgccaaaaacactagggaaccccgcacaatatgcggcgcccccggtataggggttgagcagggactttacaccccaataagcaacgccattgctaacagggaaaacgtaaactttcattttaatactccatttcaaaatgttgattaaaatttactgcgcaagacgctgatactgctcattccaacacccactccgccagctttcccgtcacctgcgtcatcaacacattctcgacatcccgtgcacccgctgcgctgcacttggcgagtacggctttgacgattcctgaatcaaactcgaactgtttgcccgttgccgccttgtaacgtccgcgcaatttctccagcttggccaacacgatgccttccagcgttgcctcgtccagcggtcgataggcaaccacggtcatgcgcgccagaaacgcgggacggaaggcttgtagcaggacgttgtgcagggcttcgttgaaggcttccgtgccgagttgtgccaccggcgtatcaagtaaaagctcagcgccgacgttgctggtggcgagcatcacggtgttcttgaagtccaccaccagcccggtaccgtcctccatcaggcccttgtcgaagacgttgtaaaacgcctccaggacatccgggtgtgccttctcgatttcatccagcaacaccaccgaatacggtttgcgccgtactgcttcggtgagtacaccgccactgccataaccgacgtaaccgggtggtgcgcccttgagttggctgacggtgtgcgcctcctgatattccgaaagattgatactgatcaggttgcgttcgccgccgtataacgcgtcggccagcgcgtaagcggtttcggtcttgcccacacccgtgggcccgaccagcaggaatactccgaccggtttttgcgggtcggtgaggccggcacgataagcctgcaaacgctgagcgatggtattgagcgcgaggctctggcccattacccgttggcccatgcgctggcccagtgtgcgcacggcgtgcgcttcgtcggcgagcatcttgccgactgggatgccggtccagccggcgatcacggcggcgacggttttggtgtcgacctgctccggcaccagtggatcgtcctggcgaatcgcgtcgagcccggcttccagacgcagcagttcggcggccagataatcgatgcgactgtcggtgtcctcatcgggtttatcgttgtcggcgcgctcactcaaatcgagcaattcgcggcgcgtgtcgagcaattcgcgcacggctacgcgctcctcaccccagcgggtttccagctcgcgaatcgcttgcacgttgctgctcgattcgctttccagcagggtgatgcgctcgcgatgatccagccccgtggcttgttcgcgacgcaggcgttcgacttcatccttcaagctgttctgccgatggcgcaggctttccagtggcggcggtacgtcgtgctgaccgagggcgacgcgggcgcaggcagtgtcgaggacgctgatggctttgtccggtagttgccggccggagatgtagcggtgcgagagtttgacggcttcatggatcgctgcgtcgaggacctgcacgccatgatgctgttcgagtttggcggccacgccacggagcatttccacggcggtgatctcgtccggctcttcaacttgcaccagttggaagcgacgggccagggccggatccttctcgaagtattttttgtattccatccaggtcgtggccgcgagcgtgcgcaactcgccacgcgccagcgcgggcttgagcaggttggccgcatcgctgccgccttcggcaccgccagcaccgatcagcgtgtgggcttcgtcgatgaacaggatgatcggtttgtcggcgctgcgcaccgcgtcgatcacgcctttcaaacgttgttcgaattcgcctttgacgccggcgccagcctgcaacaaaccgaggtcgagcacgcgcaggctgacttcctgcaatgacggcggtacatcgccggccgcgatgcgcagggccagaccttcgaccacggcggttttgccgacaccgggagcgccgaccagaatcgggttgttctgccgtcgccttaacagaatgtcgatgcactggcggatctcgccgtcgcgcccgacaatcggatcgatacgtccggcgtgggcgtcggcggtcagatcctgagtgtactgatccagcaccgagtcttgccgtggcgtcgggttgccagcgcaggcactgcgcgcgccgacatgctcgcgagagttttccgtccactccagcaggtgggcgcgcaggacttccttagggattctcagcagcgacgatgcactgttgagcagcaggctgcgacgttcatcacgatcaatcaacgccagtaacaacaaccctgaacgaatactgtcgatgcccagcacgctggcctgcaccaccgcgtcttcgagcagtcccaaggtgtgcgcagacaacgccggcgtgcgggtactgccagccttgaacagatccagtgccttgttgatttcggccgtcaacgcatcacgttcaagaccgaaacgcggcagcaggaaagccaggtcgccgccttcgatgtcgagcagttcgaggagtaaatgttcgatctcgacaaagtggtgaccgcgttgcaaacaccgttgcgctgcacgttcgagcgcacggcggttatccgggttgaggcgtccgatcaggctggccagttccatttcaggtgatctccagctgacgcagacgggtttcgatcgtttgtaccgcgaggctggcctgccgctgcaaaccaccgttccagctgagcagggacggcgcctggcgccccagcctcatcggcccggcaccgcgcaccagcagcaccagcttgacgtccaggtccggaccgaaatacaaggcggcgaggctggccaaggctggatgtgcttcgccgtccggcaaaaaacgcccggcttgcgcggcgggcaacggccccagcgtcaagcggataccggcgtgttcatcccagacccgtgttcccgccacggctgtgcgaccgagttgcaggttgcgcccgccagccttcatcaaactgcggctggcccgcggaatttcgcgccatgcaccttcgtaggcactgagttcaaccggcaccgcgaattgctcgcggacgatcgccgcaaacccggccaacgaacgacgcccgtcggcaaacagcgcggtacaggccagcactgcacaatcgggaacggcctggcgctcctgcagggatttgggcagcaacccggtcagtgcgcgcaattgtgcctgcacgggcgaagcaccgggcgtgacaaaacccaaggcgattcgatgcttgcgcatcaccttgtagagcagactgagcaggcgatgctggaacagatcaagaaattctgcgggtgcatgatccttgacccgtgcccgctgttgcagccattcctggtaggcatagggcagggggccgtcgggcccgccaagaccgaagaccggcgtgtcgatggtcaacggctcgccgggttcttcgcgcagatcttcgatctggctggcggcaaacatcggcgtcaacggcccgcgcagtttcagtgcttccgcctggggcgctgtgccgctgccgagcgattcggcttgcggctgttcgcgctccagcagcagcaacgcctgcagcaattcaaacgcctgcggatcgcggcgcagacgctggctcaaggtcagagcgacagcggcatgccggcttggggttgccataccttgacctccttgtcggcctgcatgagcactgtgcgcacaaagcgattggctgtggcgtacaccgagaaaaactgcgccagcacggcggaaaacaacaccgcgctgctgccgacaaaatgctgtggatcaagctgcaattgcacctccagaccgttgcgccagccacgccaggcgtcggcgccgacatggccgatcacccgctcgcaactgaggctcagcaggccttcgatctggcggattgcactggcctcatcgcgcaggttgtgcaggtgcagaatctccttcagcgcatccagcgcttgggggccttcgaccagcgacaggtgattgagggtcagttgcgacaccagtcgccagcgcgagtcgccgtccagccgcggcaggctttgtgggctcggcggattgcgcaggcgcgcccaggccaccgggccgggacgctcgaaacccaaaggtgtgccggcgggcaaactctgcgccagatgacgattggtgcagagcaattcggcggtgaggctgtaatcgggcagatcggtcagtgggtcgaatcgggtgtcgactacgctcagcaaaagatcgctgccgaggcggttcggggtcatcccgctgacgcgccgcgcatgccagtaacgctgttgatcgccgccgctgtgctgactgccgtaatacgccggcagcctttgcacgccggcgctggaactggcgcgcacgctgcgaatactgtggatctcgacactgttttcgcggtggctgtcggcgatcagccggtattcgctgcgcgtgccatcggggcgcaacggttcggaagtacgcgggaagaggttgatcactggcgcacagccgagcgcgatatcactggcctgcaaatgcacgcggctggcgggtgcacggtcgaagacgatgtacagatacaaggtctggctgtcgctgctgacgccgctcagcggcaggtcgaagaaatggaatttgtccgcgaacgcaaagtattcggccagcagacgcatgcccgggtgcacgccatcttcatcgggcaacagcacttcgtcatcgctgaaaccgacgattttcggcaagccctgcacgctcgtcggcacactgcccggcgaacccgcgagcacctgcacggcatgggcgccaagcaagtcatacaggcaggcgttgatcaccggcgaggcggccaagtgaatgcgcaatcgttcgatgctcaactcgcaccactggctttcacccaggcaactgagactcaggcgcaatgctgaacgtgattgcgccacgccagtcaatgcctgcgcttcatcgctgcccagcaacagcgcttcggtcactgccaccggccacaggcacaccgcggcagaggtgcgaaagtgcaggctgtcgcccttgtgagtggtgacgaacagcggagtgtcgcggggcaggggatagccttcattgaggttgcctttgctggggtccggctcgaactggacgatggcgcaggacggcagggggcgcattgccaacggatagagttgttcgagcagggcatcgctgaactcggcatagtcgtcatccaggcgccgctgcagccgtgcggcaagcagagcaaaaccttccagcaaacgctcgacatgcggatcggggcattcaccgggggacaattccaggcgccgcgcgactttcggataacgctcggcgaactggccgccagcgtgccgtagccaggtcagttcgcgctggtaataatcgagcagttgcgggtcaatcgagtcgctcatggcgcacctccagtccttgtccaccgggctcgatgacaaacgcgaccggccagtgctgctggccgctgtgcaactcgccgatcaggcgaatgctcatctgctgcggttgctcgggcacggggttgacctgaacgtcgcccaggcgcaggcgcggttcgaaatggttgatggcttcgcggatgtcccttgccaatcgacgccggtcgtcgctgcgctgctgttgcagggcactccagtcggcgatgccgtagtcgatcacgctgggtggctgggtcagcgtgtgcgggccccggcgcgtattgaacaggcgcccgagctcggcgtgcaccgagtcgagcagatcctgtcgaccgaattcccgcgtatcgtgcgtctcgctggaggcgaggcgttcgaacaacggagggcgcatgccgctgcctgccatggccgggacgccgggttagctgacaagcttgttggcggccatgtcccacgtcgacgcggcggtgccttccttggtgccgtcgtctttctgcgcggtgagttcccatttgatcttggtgaagttcagtgacacggtttctaccggtttaccgccggtgccgccgctgacactgacgttggacagcaccacgttggtgagggtgtagacgataaagggcatcaactgcccgctgccttcagcggcgttgcgaccgatggtgatgatggcttcggggatcggtttgccggcgcagcagtattcgttgagtgacggtgtcgaactgtcgacgaatttggtcagggtgaactcgccgatatgcggtttgccggaggtgcgctccgagttgctgacatcgttggtgacttgcatggcgacgttgtggctgtaggacatgacttcgatcttgtccgcaaaaccttcgagcaggctgtcgcctttgatatcgccgccgaggtcgagaatgattgcatccatcgcttgaaactcctgaagaaaatcacattaggcaaatgggctgaacacgaaacccgtggcgaggggataaatcctcccgccatcagggttttctctggggctttaagcggcaaccggcggcggtaaggtcgccaccaggcggatcgacgccgtcagctcctcaagctggaagtgcggccgcaggaacaccgtcgcgcgataagcgcccggcttgccggccacctcggtgacgtccacgcgggcctcacgcaacgggtactgcgccttgatttcctgtggcgcgttgtcgttgatcagcacgtaatcggcgatccagttattgaggtaggtctgcacgttgtcgcgggtcatgaaactgccgaccttgtcgcgcatgatcaccttcaggtaatgggcgaatcgcgaggcggcgagcacgtacggcaacatcgccgagatccgtgcgttggcgttggcctcgttggtgttgtagaccttggatttgttagtggtctggccgccgaagaacactgcgacatcgctgttcttcttgtggcacagggcgatgaacccgaggtcgttcagctctttttcgcggcgatcggtgatcgccacctcggtcggacatttcaacgacaaatcgccggagctggtacggaacgtatgcgctggcagaccttccaccgcgccaccaccttcagcgccacgaatcgccgcgcaccagccgtacttggcgaacgcctcggtgatgcgttgtgacagcgcccacgcggcgttgccccacaggtatttgctgtggtcggtgccgttgacgtcttcgacgtaattgatgccttccaccggcgaggtatccgggccgtagggcaggcgcaggaggaagtgcggcagcaccagagagacgtagcgcgaatcttcgctctcgcggaacgagcgccacttgatcagctcctggctctcgaagactttcgacagatcacgcggcacggccagttcggtgaagctgttcatgtcgaacaggcgcgggctggcggcggcaatgaacggtgcatgtgcagcggcggcaacgttcgagagtttttccagcaggccgatgtcctgcgggtgacggccgaaggtgtagtcaccgaccagcaagctgaacggatggccaccgaaggtgccgtattcctcttcgtagatcttcttgaacagtgcgctctggtcaaattcgacggccttttccaggtcgttctgcagctctttttgcgtcacgttgagcaggcgcagtttcagtcgggtgctggtttcggtgttctgcaccagcatgtgcaggccacgccacgaggcctcgagtttttgcaggtcggggtggtgcagcacctcgttgagctgggcgctgatcagctcgtcgatctggctgatgcggtcgttgatcatcgccacggtgtccttgtcgatggccatgccttcgtcaagtacctgagtggcgaattccgcgagcatgtcgcgggcgtaatcctgctgactgtcatcgtgggccatgcggccctcgagaatgatctggtcgagcagggataaagtctggttcgtaccttcactggcttgttgctgggcggcggctggcatgacgaattctccctcgattcaagtggacgatcaggcttgcggttcggccggggcgtcagcggccggggtagcggtgtctgggcgggccgatttgatttcctgcaggccttcggtattggcgatgacatcgcgcaacagcttgtccaggtcatcgttgccgtcgagcttggtcagcagatcgcgcaggcgctggcgggcctcgaacaaacggcgcagcggcgtgacttgctccaccaccttgaccgggtcgaaatcgtcgatgtgtttgaaattgagttcgatattgagcttgctgtcgtcgccgctgagggtgttgttgacctgcagcgtggcgcgcgggctgatcgaggcgagcacttcgttgaagttgtcgcggtcgatttcggtaaaacgccgttcagtcagttttgccaatggctcaagcggcttgcccgacagatcggcgagaattccgacgaccagcggcaattcttttttctcgatggcgttgccgatttcgacgtcgtaggtgatttgtacacggggcggacgcacccggtcgagcttgtgctgagtactttctgccatgacggcggactccgatgcgatgggcgggcgcaatgcatcgggaggcccgttcatcgctttcccttactggaccgtaggttagaaaggggagcagatgacctgtcgttcctttgacaaaccttcctcattcgacagtgcctgtcgaactacccaagacgctagaacaggtctataaaaatgcaagcaaaaacatttttggacgggctcggaaaaggaaaattcattttgtgcggacgattttttgtagcgctcatatttgcgctgctggcgggctgttccttcttcgggccgaaggtggacctcgacagcctgatcctcgatgtcgcccccaaggccaatgacgacacgccgatcgcggtggatttcatcgcggtagccgatcccgatctgctcaagcagttgtcggctatcagtgccagccagtggttcgccgggcgcgagcagtatcagcgcgactatcgtcagttgatgagcgtgtggggactggagctggtgccgggacaattcatcgaccgccaaccgttccctttgggtggcaagaaggcggctggacttttggtcttcgccagctataacactcccggagcgcaccgcttgcggctcgatgatcagagcgaagcgtggctgaaattcgacagccgcgagatgagtctggtcaacgccaccgagcactgaaatgccaccgctgccgccggatcgcggcttggtcgaagggagtcgtatgagtctgctacctgacgcggtttgctggcacgaaggcatgcaattgctgccgcagcattttcagttgcaagggctgcgggccgaagcgctcggcgcgcatctggcgctggcatgtaatccttggttctggggcgtcagccacatggagttcgatccatcggcgctgagtgccggggtagtacgggtgttgtcgctgcagggcaccatgcccgacggtttgccggtggacttgcaggccggggtcggaccgacactggagctggatgtcagcgcggcgatcgatgctaccgacgatgcgacggtcatcgtgtacctggcgatcagcccgatgtggcgggccggtcagttgctgccgctcaagggccgcttgcagtcggtagtcggcgaggcgttgccggatctcaccagcggcgagttccctgagtcgatcaccgtctggcgacccaacccgcggttatgtacgcaactgaacaaggccgattcgatctgcttgccgctgctgaagatccgtaaggagggcggcggtttcctgccgctgtcttacaccgcgccgacgccgaccctgttaccggaatcggcgctcggtcgacgcatcgccggcctctgtgcgcgggcacgggaaaagtgcctgtttctcggtggtcgtttgcgtcaggcgcagcaggccggcaatcaggacgacgcgctggaaatccgtcggcagttgaccgcgttgtggctgcgcctgccggaaatcgaaggcctgctgaacagccgcatcgcgcagccgcagatcctctacgtgcaattgctcgggctggctggtgcgtggtcggcgctcgatccgctggccggtgtgccggcgtttgcgccgctggattttcttgagttgcaacgcggttacgacgccgtgctgcaatggctggaaaccaccctcgaactgatccgcgccggctaccgcagcttgccgttcgagcgtggtgaacagagcttttcgattcaattgccggacgagcagccgagtcagcgtctggtcattggtctgcgcatgcccaacggtgccagcgagcaagccgcgatcgactggttgcgcggcgcgatcatcgcttcggcgccgcacatcgcgttgctcagtcgtcaacgcatgagcggtttgagccatcaggccatgagccgcagcgaacaggtggcctacagcgtcggcgaggacacgcggctgtttgtgctgacggccgaaggcgcgtggttcgacgcgcaactgccgctgatgatcgccgcaccggcggcgaagctgaccagcagtccgtggcaagtggtgctgtttgtcgcccagaacagtgaaagcgcctgatcacacaaggaacgccgtatgtcgcaaggaagtgccgcaagccttgggttgcaggacgcaccgttgagcagcgcgttccgccagacgtggcagcaatggcaacaggactgggtgcaattgcccaaggacagcgaggacgaagcggcgttggtggagaccgttgtcgaactttcgacacaggcttcgcagcgattgtggcgcaccgcttatgcgcgggtcggcgattcggcgaccgagcaggtcaaggcgctggtgtatgcattcgtcgcgctggtcgatgaaaccctgctgttcacgccatggcccgggcaagcggcgtggcaggacaaacccttggagtcgcggctgtacgccagccggcaggccggtgagcaagtaccggcggcgattcagacactgctcgacgagcagcagccgaccacccgcgatctggccaatgtctatctgcagtgcctgatcctcggctttcatgggcgtctgcgtggcgaacacagccaggcgcaattggagaagtggcggttggcgctctacaccttcgcctggcaggacgaagcgagttatggcggagtcagtcagcgcttggtgcagccgtcgctgaccactccattgcaactgccggtgcgcacggcgctgccggatggctttcgcctggcgctggggattctggcgatgctgctgttgctgaccgggctgggtcagttcctctggcgtgacattcagtcggagctggacccggtgctgcagatcatcgactcgatggcgccagcggagcaagactcatgagtaccctgacgatagtcgcgtggattgtcgcgttgctgctggtcgtggtgatcatcgccgtggcggtgtggtggttgcgcacccagagcggcgccgcgatccgcagtttttatgcggccgtgcggcaaatggagcaggagcagggcagtcacgaccgctatcagatgccatggctgttgatgctcggcgacgaaaaccagggcacgcaactggtcagtgaatggcgtctgcaaccgaccgacaaaccggcttggttcggccgctggtggtcagatcccgaaggcgctgtgctggtggtgccacaggcgctgtttctgcccgacgacggcatgcatttgcagcgcggcggctggtggcgtttgctgggtttgattttgcggatgcgcagcaagcggccgctggacggggtggtctggctggtgccggtcagtcgcctgagcaatctggaacaggccgccagcctcggtctggccgcgcgccggcgcttcatcgatctgctgcaacgttttggtctgagtgtgccggtgtacgtgatcatcaccggacttgaagaattgccggggttccaggaactgatcagtgcgctgcccgacgaggcccgcgaacgtaccctgggctggtcctctccatattcccgtgatgcagtttggcaagggcagtggagcgatcaggcgctcgatcgcatccatcgcgcggtagcggaagccattatcgaaatcggcacgttgtccggccagttgagcgccgatctgtacgccttgccggagcgtctggaaacgttgcggcgtggtttgcagagtgttctggaaccggtgtttcaaggtaacgcccagggtgaagcaccgtgttttcgcggtgtctatttcagcgccagtcaggcctcggaggatgccaaagacggattttccgccgacgacagcggcttgcagcaaagcgtgttcgtgcgccaattgtggcgccagcgcctgatcggcgaacgcgggttggcgcaaggcgtgccgcgcctgctgcgtttgcgtcagcgttggcagcggctgacggccggcgtggcgctggtggtcggggtaatctgggcggtggcgatgctttgggtctggcaggtgtcggtcaaggatgcccacgaactggcgcggcagatgcaaggcgcgcaaaaaggctacgtggcgatcagcgacgaggcgcagcgggtcgactcgacccgacgcaatgtgcagaccttttggcgggtgctggagcgtgcgccgcactggaactacgtttctctggtgtttccgacgtcgtggttttcctcgctcgacaatcaactcgaacagcaagtcttgcagtccacccagcgccatatgatggtgccgctgcatgatctgttgagcgcgcaactggcgcagatcaaggcgatccgcagcaccgaccgacgcagcagtgtcgaaagcgacgacccggcgcagtggcagaactatctgaaggcgaacgatctggtggatcgggccttgcgtctggaacagcagaaccagttgttcaatcaagtgcagaacaacccgcgcgccccgctagacgacctggtgcaactgagcaacaacgcgctgtcgctgaacctcaacacgggcaccttgccctatgcatctttctacaatcggctgctcgtggccggagaagacggcagcttgcaggcgctggatctgagcgtcgaccgaccgcagatcgtcagcaatttttccgggttgatgcagcgctggctggatcaatatttcctcgccgacaactttgtcagcaaggctggctacctcaaattgcatctggatcaactgcaagctggcagcagcaacagcctgcgggagctggaagacctgaccgcgctggtcgacgatctgcaagcggcgatcgccctgaccaattcgacgtggagtcgcggcaagggccaggagctggtgccgggttatggtgacttcctcgccaaagtgggcaagagcacattgttgggcgcgcaagtccaacaagacctcgacacgcaagcgtcacgcttgcagcagagtttccgcgatcaatggatcgcacaggtcggctcgcgggacaatttgctggtacagcaagtcagcgggcaattggcgttgcaagagcaagtggtgaaactcgataacgcgatacaggcactgttcaagcgcgacttcgtttcggtcgccctgcgtgctagcgaagacaacgtcaatatgcaaggccagaccgtggacggtgatgacctcaatgaatcgctgaaatatttcgccgactacaacagctacatcgccgaagaactgccacgcattccaccggactatcgcgttgcggtgctcaaagccgccgagcgtgccgccgcccaggcgatgtggttgagcctcaaggatcacaacgatcaggcgcatccttacgcggtgttcaatgtgcaggccgagcaagccatggccctgcaaaaggctttcgtcgaggtgcaccgcgcggatctctccacccgcctgcaagcggcgcttaatcgccgcgccatggcgcagcttattggtggtctggatgaaatcaccgcgcaaccgctgttcggcggacgggccgaaatcagccagtgggacggctcgaaaaacctcggactggaactgttcggcgccagcgacgtgcaggatctcaaactgagcctcaagcagcagttcaacaccatgctcggcatcactgagcggcggacgtcatcgttgcagtggctgacaacgcagcaagccaatctgtcggcactggattacgaacgcgtgacgcagttcagtgcgctcaacgacgaactgcgcaaatacaaagaggccaacccggccagttcgccggcacagatcgagcaactggtcagtcgcgacttcgtcgagatggacgtcaattcctgcctgcaaatgttgcagaccgccaacgtcgccggcggacgcggcacgttggcgatgcgcgcggtggagttgcagcaggaggccatgcagcgttgccagatgctgcaagtgcaacaggccgctgcggcgtggaatgaactggccaactacttcaatcaatatctggcggatcgctttccgttcgctaacggcgtgcagatgcaggacgccgatccggcgcgggttgaatattttctgcaactgatcgacaaaaaactgccggtcgcgcaggccggccttgccaccaaccagactccggagcgcctggccgcggcggattttctcaaccgcttgaagcaggcgagcacttggctgacgccgctgttcgtgcgtgacaagagcggcatccttggcgtcgagctggacgttcgctggcgcaccgatcgcgatgatgagctgggcgccgatcaggtgattgcctggggcttgctcgccggcaatcagcaaatcaactatccggcagccgagcaaccgaacctgcgctggatggtcggccagcctgtccgcctgaccctgcgctgggcgcgtaacggcaaggagcggccggtcaatgatccacagcaaccgaatctggtggtgcgtgatctggaggccggttgggagtacggcgggccatggtcgctgctgcggatgatgcgtgcgcacttctcggtgcagcgtcagccaaacgtggattacaccgaattcccgctgacgttgcgtttacctgtaaccggggcgccggacagcgtcaccagcgaattcacgcggatgttcgtgcgtctatcgttgatgagccaaggttcgaaactgccgctgtcgattgcaccgttgccgacgcgcgcaccgcgctcgccgtttaagttgagcagtagcaccgccgccattgaatcgcagaaggagagcttgtgagcctgccatcgaccgcactgccggacctgattgatcagttgctcgcgccgatcagcatggacacgccctgcggcgtcgatttgcgctatgaacgcgagttcgaccaactgcgcgacctgcgccgcgaggatgacgccagtctgccgaccggggtctggcagtcgacgttgaaacgggcgaactggccagaggtggagaaactcaccaccacgctgttgctggagcgcagcaaggacttgatgctcagcgcctggctcggtgaagcctggctgcacctgcaagcgctggacggattgcccggcagcctggcgctgatcgccggtttgtgtgagcgctttcctgagcacctgcacccgcaggccgaggacggtgatcagtcgtggcgggtgattccgctggaatggctggtgcgtcgctacagtgaaatattgctcacgcgggtgccgctgttcggtgctcgcaacagcgatttcgagcattacacgcttgaagtctggcgccgtttgcagattcagcaggtgcagaccaacgacagtaaaaatgccaagacctcagcagaagccgcccgcagcgaacagaagaaaatcaacgaacagattcgtgcgacccccctggcattctggttacgcacccaaggcaatctgctgttgagcctgcaacacttgcaacggctggagcgctggagcgatgcctttctgggtgatcaggcaccggggttgcgtccattgcacgaaaccattcaagcgctgctgacgctggttcaggagtttatcgccatgcatccacaacaaccggcgccgccagcgcccgtcatcgaaacgcctgtcgtggtggcgcagcctgaagagcaagcgccgaccgcatcgctgtttcgtgagccggccaaccgtgaagaggcctatcggcaattgttgttgatcgccgaatacctggcccgcaccgaaccccacagtccggtgccgtacctgatccggcgcggggtcgaatggggcaataaaccgctcagtgaattgctcggtgagttgatttctgccgacgccgaatcgcgacgcttgtggacgctgctcggggtgctttagtgcacccgctgattgctgatttttggcggcaaggcgatgggcgtcagcactggttgtccggagaagaacgccatcaggtttttccctaccagctccaccgtgccttgcatggcttgcggtgacaggcccgcgacgtgcggggtcagcagcacattgccgagcgctttcagggcgtccggcacttgcggttcgtggtcgaacacgtcgagtgcggcgccggcaatgcggcgttgctcaagggcgctgatcaggtctgcggtggcgatcacgctggcgcgggcaatgttgacgatgaacccgttagggccgagcgcatcgagcaccgggcgcgtcaccagatgctgcgtgccgatcccgcctggcgtagcgacgatgagaaaatccgaagcccgcgctaattcagtcggcgtcgagcagaacgcgtaaggcacatcgctgcgcaactgacggctgtgatagctgatgtccatgtcgaagcccaggttcgcccgttttgcaatcgccatgcccaccgcccccaacccgagaatacccaggcgcttgccggccagcgacgggcgcatgattttcggccattccccccgacgcaccgcggcatcgcaacgtggaatgtcgcgcaccaacgccaatagcatcgccatggcgtggtcagccaccgacgaggcgttgactccggcgccgttggtcacggtgatcccgcgatcgctggccgcttgcagatcgacctgctcgtaaccggcgccgatcaccgtgatgattttcaacgcgggcagggcggcgatttcctcggcggtcagacccagcgggccacgggtcagaaccgcgtcaattcgcgcgccgtgggtggcgatggcttgtgctcgttcggccggtgtcggcgccaggatcaggtgaaagccctgatgttcgagaatcggcaaatagtcattgatggtttcaaccagtaccagaacggttgcgggcattgcgcggctcctgtgaacgtcggcggattgttcgcgaaagtcgtttcagagtgctgattccagagcggtttggcaatggtggccgctaccccgtatcagccagtgtaggagctgaaacggggcgcgcgcgggcgcttcgtcagaacgtcacgtcggcgctgttgatcaatcgggcgaacgcagcgccaagggttgcgttgtggtgatcgacgatggcttgcgcgggcaacgccgcagtgtccatacaggtgtgggcgtcggccaccagcagcggtttgaagcccaggtcggcagcggcgcggcaggtgctgtcgatgcagaactggcttttcatcccgacgatataaaggtcgtcgatctgtgcggcactgagttgctgcgccagttctgtaccgtggaaggcgttggggcgggatttgttgaagagggtatcgatttcagcatccaggccaagttcaggcagcaattgccagaatgaactgccgacggcaatcggcgaaccctccgggccggtatggcgcacggcgaacaccgggacttttttcagccgcgctttcttgatcagccgctgaatgttggcgagggcgtgttcgccttcgtgaggtttttccgggccatggaacaagccgacctgcatatcgatgatcaacagtgctgcgggcatggtgttactccttgggtgctgcagatgccgcacggacgggagaaacaaccaggccccgtccattgctggcggggccttgggtttgctgcgctgggtttacctcacgcacaaacaccacgacccgccggtggcggtcgtcgtggtggtgcgggtgaggtgcagcgcgcgaaggttcatgaggccgatcatgctggcgccggtagctggctgtcaattgcggggtcaggtgacgtactgagcaataccattgccgaatgaccagttctctttttttacctcgatcagattgataaatacgtcttccaggcgcaccgccaattgtgtgcgcaggctttcggcgatggttttgaacagcaactgctttttctccaccgtgcgcccttcactgatggtgatctgaatgaacactacgccatcgctgcgctggatccccagatactgcgggtcgtagacgaggtgctgactgtcgtgctcggtgaggatctggaagttgtcgtgctcgggcacatcgatacaactgcgcagggccgcgtagatctgttcgccgatgcgtttggcgaaggtggggtcggggttttgtttgatgtcgacgcgaacgagaggcatgggcagagactccgggaggggactcattcacgctagaacatatcaaccacattgaaagtgtgaggtgatgacctcgcgactgtttttgtatgaggctacctacgaaactcgcggattttacctacgcatttggcagagtcatctgctatcgggcagacggttaacgcgaaatcatggggcagcaatgggaggtggtccaggatggaaaagcttcccgagcgttaaatgtcagcagccaaggaaggtaaatgcatcttgatgaccacaaaaatgtggagctcgaaaggctacaaacggaaaccaaaaagctcggcgcgcagaggcgcaaagcttttggcggaggaagcaaaactgaaacttgagacttttttgtatccccttgtggtgggggctggggcattaactgcaattgccaccgccgttgggctttatttgaagctgtaagagagcgcagcaggttgccgttgcgcatgcgtgttgattcagagcaccaaaaaaagggaagggggcagtatgagcacagaggaaagcagagccaggatagaccgactgtatcaagaggagtttgagttcagagaagccatgaagccctttcgcaaagccgaaaggcgtgaaacggttttgctgtttagccttggaatgttgatgggcgcggtggggatcgctttcgtgatggtgttggctcgaaccatctgaatacccttgcatgtgcctgttaacgacatcatgaatacctgtttacgacagataatttcccaaaaacgacgccccgctgatctgctccgcacaaccattcctcagctaagtctttgcttctgctcatttatcgcggagaatcgcgcccctgtttcggccggagcatgtctgtcggttttttccgacgcgtcctgaccgagtggcaagtgaccggaatgcggagatccgaccggatgaatgatcaggccaatagcgtcgaagagcgctttgatgcagcagcacccgctgaactttcgagctggaatcgccaggacaccacctggatgttgggactgtttgggacggccatcggcgccggcaccctgtttttgccgatcaacgcaggtctgggtggcttctggccgctggtgatccttgcgctgctggccttcccgatgacgttctacgcgcaccgtggcctgacccgcttcgtgctgtccggtcgtgagggcgccgatatcacggaagtggtcgagcagcatttcggcatcaaggctggtgcgttgatcaccctgctgtacttcttcgcgatcttcccgattctgctgatctatagcgtcggcctgaccaatacagtcgcgagtttcctcgaacatcaattgcacatcacgccgccaccgcgcgcgctgctgtcgttcgtgctgatcctcggtttgctggcggtggtgcgatgcggcgagcaggcgatcgtcaaggcgatgagcctgatggtgtacccgtttatcgttgcgctgctgtttctggcggtgtacctgattccgcactggaacggcggcatcctcgccaccgcttcgcatgtgccggccccgtctgcactgctgcatacactgtggttggcgattccggtgatggtgttctcgttcaaccattcgccgatcatctcggcgttcgccgtggaccagaagcgtcgctacggcgtccatgctgaagagcgcagttcacagatcctgtcccgtgcgcacctgttgatggtggcaatggtgctgttcttcgtattcagctgtgtgctgaccctgtcgccggagcagctggctgaagcgaaagcgcagaacctgtcgatcctgtcgtacctggccaaccatttcagcaatccgactatcgccttcgcggcgccgttgatcgcgttcgtggcgatttccaagtcgttcctcggccactacatcggtgccagcgaaggtcttaaaggcctgatcatcaagagcggcaagcgtccgggtgccaaggcactggaccgtattgtggcggcgttcatgctggtcgtgtgctggatcgtggcgaccctgaatccgagcattctgggcatgatcgaaaccgtcggcggcccggtgattgcggcgattctgttcctgatgccgatgtatgccatccgtaaagtgccggcgatggcgcgttatcggggtcaggcgtccaatgtgtttgtcaccgcggtcggtctggtggcgatctcagcgctgatctattcgctgacggcttaaagaccgcagcaacaagagaccgctgcactcgatgggtgcagcggttttttttcgtctgtttgaaagcgagttctatgaaggtgacagggacgcagagcgccccgggctgcattcccacgcagagcgtgggaacgatcaacgattagtctgcaggcataaaaaaacgccgcacatctgacgatgggcggcgtttttcagtgcgttgtaacgttaggcttgaacgaccggaatgttggcgttcgcagcagcttcacggaactcggcgatctggtcgaaggacaggtagcggtagatatcggccgccatgctgtcgatcttgccagcgtattccatgtactcctcgacggtcggcaggcgacccaggatcgaagccacggacgccagctcggccgaagccaggtagacgttcgcgccgtcgcccagacggttcgggaagttacgggtggaagtggagaccacggtcgcgttcggctctacacgtgcctggttacccatgcacagcgagcagcctggcatttccatgcgtgcgccagccttgccgtagatgccgtagtagccttcttcggtcagttggtgagcgtccatcttggtcggcggcgacagccacagacgggttggcagctgacccttgacctgatccagcaatttaccggcagcgcggaagtgaccgatgttggtcatgcacgaaccgatgaacacttcgtcgatcttctcgccagcaacgctggacagcagacgggcgtcgtccgggtcgttcggcgcgcacagtacaggctcgctgatgtcggccagatcgatttcgatgacttcggcgtattcggcgtcggcatcggcttccatcagttccgggttggcaacccaggcttccatcgcttgagcacgacgttccagggtacgtgcatcgccgtagccttcgccgatcatccagcgcagcagggtgatgttggagttcaggtactcggtgatcgactctttcgacagcttgatggtgcaaccggcagccgaacgttcggccgaggcgtcggacagttcgaaagcctgttccagggtcagaccttccagaccttcgatttccaggatgcggccggagaaggcgtttttcttgcctttcttctcgacggtcagcagaccgttctggatagcgaagtaaggaatcgcatgaaccaggtcacgcagggtgatgccaggtttcattttgcctttgaagcgcaccaggatcgattccggcatgtccagcggcataacgccggtggccgcagcgaacgcaaccagaccggaaccggccgggaacgaaatgcccatcgggaaacgggtgtgcgagtcaccaccggtaccgacggtgtctggcagcagcatgcggttcagccacgagtggatgatgccgtcgcccggacgcagggaaacgccgccgcgggtcatgatgaagtcaggcagggtgtggtgggtggtcacgtcgatcggctttggatacgccgcggtgtggcagaaggactgcatcaccagatcagccgagaagcccaggcacgccaggtctttcagttcgtcacgggtcattggaccggtggtgtcctgagaacccacggtggtcattttcggttcgcagtaggtgccaggacggatgcctttgccttctgccagaccgcacgccttgccgaccattttctgcgccagggtgtaacccttggtgctttcaatcggagcatcaggcttcttgaacaggtcgaacggtggcagacccagctcggcgcgagccttctcggtcaggccacggccgatgatcagcgggatacggccgccggcacggacttcgtccaacagcaccggagtcttcatttcgaaggtggtcaggacttcgtcggtgccatgtttgcagaccttgccagcatgcgggtacaggtcgatcacgtcgcccatgttcatgttggaaacgtcgaactcgattggcagtgcgccggcatcttccatggtgttgtagaagatcggagcgattttgctgccgaagcagaaaccgccagcgcgcttgttcggcacgtaaggaacgtcgtcgccgaagaaccacagtaccgagttggttgccgatttacgcgaagaaccggtaccgaccacgtcaccgacgtaggcgatcgggaagccttgaccgcgcatttcttcgatctgcttcatcgggccgatggcgccctgctgatcaggaacgatgccgtcgcgagccattttcagcatggccagggcgtgcagcgggatgtctggacgcgaccaggcatctggagcaggggagaggtcgtcggtgttggtttcgccggtgaccttgaacacgcgcaggctgatcttgtcttccagcgttgggcggtttttgaaccactcgccgtcagcccaggattgcagcacggctttggcgtgagcgttgccgttcttggctttttccgcgacgtcgtggaacgcatcgaacatcagcagggtgtgcttgagttgcgcggcagcgactggcgccagctcggcgtcgtccagcaggtcaaccagagtgacgatgttgtagccgccctgcatggtgccgagcagttctacagcgcgctttttgtccagcagaggggaggaaacttcgcccttggccagtgcagacaggaagccggctttgacataggccgcttcgtccacgcctggtggaatgcgattggtgatcaggtcaacgaggaattcttcttcgccagccggagggtttttcagcagctcgaccaggcctgctgtttgttcggcgttaagcggctggggaacgatacccagggctgcacgctcttcgatatgtttgcggtaggcttcaagcacagttattaccctcatcagtggtcccaaatgggtgtccgggacgctcatcccgaaatggtcgtactcatgcgctgcgtggcgttgtgggccacttagccagaattaccgaccattccttacagaagctgctttcaaagttttacgcctgcagaacggggagctgatgagggttggcgatgggcttttccccgctggaaaaacccttcgccaacaccgctctgaaggaacgactgtgctcgtgacgctttgaaaacagcttctaacggacattggcgccttaaaaggctggctgattctacggcaaaaaaaatttaaaggtaagttcgtccctgaagtttgaggggtgatgaatgttagacaaagggctaacatgccgacctgttccgcgtttcagtgcctttgcctaccttatgcccaatcagaccatcaagaccccctgcgtcggcctctgctccactgtttacggtgatctggtgtgccgtggctgcaagcgtttccaccacgaagtgatccattggaatggttacaacgaggaggaaaaacgcgcggtgtggttgcgtctggaacaattgctgtcacaagtgatggcggccaaggtcgagattttcgattcagcgcgcctgcgcgagcagctcgaacaacgcaagatccgcttcgtgccgcatcagtcggaatattgctgggcgtatcagctgatcgcccggggcgcacgggtgatcattaatctggaagcgtacggaatggtgttgctcccggagtttcgcgagtggaacctgccggaactgcgcgatgccattgatcgggaattcttcctgctgtcggaagcgcactatcagcgctacatcgcccccggtttccttaaagacgcctttggcgcctagaagcttcgcgagcaagctcgctcccacatttggaatgcgtacccctgtaggagtgagcctgctcgcgatgaggcctgtacattcaacatagtcttcggccgatacaccgccatcgcgagcaggctcactcctacatttgaaatgcgtaccccctgtgggagcgagcctgctcgcgaaggggcgggttcagacatcgcaatccctaatgcttcaccgccaactccaccagatgatcctcgacctcctgcggtttgagcaccagcacatcactctccagcgcatccagcaccacttcggcggtattgccgatcagcgcccctgacaaaccggtccgcgccaccgtgccgatcacggtcactgccgcctgcagcttgtgcgccataaacggaatcagcacatccgccgggccttcctcgatttgcagatgttcatcatcgacatcgaattccgcctgaaacgcccgacactgctcgcgataacgcgcttcgatggtttcgctcaattgcagggtcgggtccgccgccgacagcatcggtgaaggatgcgccgcgatcacatgcagatgtgccttggccaggctggcaatgtcatagccgtgatcaatgatcgtcgtgtgcaaatgccggtgctcgccatcggcattgccgacatcgacggcggccaggatcacgcggtctttccaggacgtggacgttttcaccagcagcaccggggtcgggcagtggcgcaagagtttccagtccgccggggtcagcagggcctttttcagcgggctgtcggggaaatgctgtttgaccaccagcccgcagccctcggcctgctgcacatcgatgatggtttcgtgcaggctctcgttccacgcctgttcggtggtcacgctgtagccgtcggccagcagcgcggctttgagcacgccgagcatgccggcatggtcgtgcttcctgtcgcacaccagcaggtgcagatgggcctgggtcacgcccgcgatcaacttggcgcgcttgagcgcaaggctttccgaatgttcgggttcgatgaccaccagaatgctgcgaatggcttgcatgagcggagtctccagcaaagaaaaggcacggcgttgcacaactatagttgctgctcatgcgcctgcgacttgatgcatatcaacgcgggcgactggtggtctgtgggcaggccggtataatcggcgcctttcgctcgaatacctttaccgtgagccccatgatctttcccgaaatccacgaattccttggctgtcgcacccccgatgcctgggttcaggctgcactggccgatcaggaaaccctgctgatcgaccacaagaactgcgaattcaaagctgccagcacagcgctgagcctgatcgccaagtaccattctcacgttgacctgatcaacatgatgtcgcgtctggcccgggaagaactggtgcaccacgaacaggtgatgcgcctgatgaagcgccgcaagatcgagctgcgccagctgcatgccggtcgttacgcgtcgagtctgcgcaaagtggtgcgcagccacgagccggtgaagctggtcgatacgctggtggtcggggcgtttatcgaagcgcgcagttgcgagcggttcgaagcgctggtgccacatctggacgaagaactcggcaagttctactttggcctgctgaaaagcgaggcgcggcattttcagggttatctgaagctggcttatcagtacggcgatgcgaaggatgttgcgcaggtgatcgagcgagtccgcgctgccgagcaagagctgattgaatcgccggatgaagaattccgctttcacagcggtgtgcctgccaccgcatgactccgtgtaggagctgccgaaggctgcgatcttttgctcttgaaaaagccggatcaaaagatcgcagccttcggcagctcctacagaggtagcgatcagtgcatgaatgttaaaaactcttaagagtatgaaacatcaccgaaaaccggctgccgcccgcgaatcccgccataatgtcggcccttacacatgggttggcacacggtcgttatggataatctgggttttggcaaagtcctgctggtggaagacgacgagcgtcttgccgcgctgatcgcccacttcctcgaacaacacggctacgaagtccgctcggtgcatcgcggcgatctggcggtggccgcgtttctcgaattcaagccgaaagtggtggtgctcgacctgatgctgccggggcagagtggcctgcacgtgtgccgcgaaattcgcagcgtgtcggatacgccgatcgtgattctgaccgccaaggaagacgatctcgatcatatcctcgggctggagtccggtgccgatgactatgtgatcaaaccgatcaagccgccggtgttgctggcccgcctgcgggcattgcaacgccggcaggtgccggacagcagcgtggtcagtctgttggagtttggccacttgcgcatcgaccgcagttgccgcgaagtgcgcctggccggagaaatcatcgaaatgaccaccatggagttcgagctgttgtggttgctggcaagtgcagcgggcaagacgctctcgcgcgatgacattctcaatcgcatgcgcggcattgcgttcgatgggctcaatcgcagcgtcgacgtgtacatcagcaagttgcgcaacaagctcaaggacaatccccgcgaaccggtgtgcatcaagactgtgtggggcaaggggtatctgttcaatccgttcgcgtgggagctgtagatgctgcggttatttttcgggctgtttctggtcatgacggtggggctggtgttggcgttgcagacggttgaacacacgttcgatgcgctgctcgattatcagcaacgcgactacaaccgtgaagccgtgcgcggtcaggcctggacgctcactcagcagttacgtgaactcgatggcccggcccgggaaaaccagctgcaatcgatacgcccgcactacgggctggggctgacgctggtcgatgccggccaactgaacctgagtgacgaggaaaaagcggaactgagcaatggcttgctggttatccgcgaaaaatacagccaatacatttcagccatcgatggcggcacgcagctattgagtattcgcttgcccgccgagccgagcctgatgcctttttacatcgtcgcggcttacctgatgattgccgtggtgatcggcatcgtcctgttcttctgggtgcgcccgcactggcgtgatctggaaaagctgcggctggctgccgagcgttttggcgacaacgacttgtcgtcgcgtattcaattgtccaaacgctcgaacatccgcgaccttgccgagcacttcaacctgatggcggcgcgtatcgaaggcctcatcgccaatcagcgcgaactgaccaacgccgtgtcccatgagctgcgcacgccgattgcgcggttgtcatttgaactcgatcaactcaagcaacaacccgacgccagtcagaatcgcgagctgattgccgacatgtacgccgacctcggcgaactggaggaaatggtttccgaactgctgacctacgccagccttgagcgcggcgcgacggtgatcaagcgcgagaatatccaggctgccaactggctcgacagtgtggtcggcagcgtcgcgctggaggcggaagcggcgggggtgcaattgttgatcggcgattgccggattgaaacggtgcgtatcgagccacgcttcatggcgcgggcggtgatcaatctgctgcgcaacgcgattcgctacgccgaacagcgggttgaagtgaccctggtgcgcagcggcgattattacgaagtgcgcgtaaacgacgatggcccgggcgtgccgctggaagggcgggagaagattttcgagccattttctcggctggatgccagccgggatcggcgtaccggtgggtttggtttgggactggcgttggtgcgacgggtgtcgcagtcccatggcgggcaggttgaagtcggcgaatcggagtggggcggggcgtcgtttcggatgagctgggcgcatctggattgaattgtattggccgtgctggccccatcgccagcaggctagctcccacagagttggtcggtgttgccactgtattggcaacgccgcaagaccttgtgggagcctggcctgccagcgatggggccggcacaggcagtaaaaaatcagctgaagatcagaaatcccatttggtcgtcagcatcacattgcgcggctcgccgtagaacgtcgtgtcgaagttgcccagccctgtcaggtagcgcttgtcgaacacgttgttggcgttgaccgtaaagctcagatgctcgttgtactgatagcggctcatcaggtcgacaagggtgtagccaccttgcttgatgcgcgtgtaatcgccggccggcgcactgtagatcttgccgtagaacgcgctctgccagctcacaccgccaccgacggtgactttgtcgagcaccccgggcaaacggtaggtggtgaaagtgcgcaccacgtgttccggcttggtggtcgacagcggataaccgtagatgcgctgctcgtcggcatcgcggctgcgcgcgtaggtgtagccggcggagacgttccagccgtcgctcagttcgccggccagctccagttccacgcctttggtggtggcgccgtcgatggctttgtaaatgccttcgttggtcaccgcattggtgccgatcgactcggcaacgccgtcctgttcgatgcggaagaacgccaggctggcgttcaggcgaccgtcgaagtacgcggctttaaggccggcctcgtagctgtcgccctcgaccggcgcgagggtcgagccgttgctgtccttgtaggtttgcggttggtagatgctggtgtaactggcgtacagcgagtaggtgtcatcgaggtcataaaccaccccggcgtagggtgtgaccacgccgtgttccttgtagctggcgtgggtgtcgtcgagcccggcgcccgggttgtagccgtagtcttcgttgtatttgaaggtgctcaagcggctgcccagaatcaccgacaaatcatcggtcgggtgcaggcgcgtggccaggtaaataccgttctggctctgcgtgcgctcgtacttgccgttcttcgggaagtcctgtttcggcaggtcgccgctccagtcgtaaatgctccccgggacttcggcgaaggcgctggtgtcataggtcgaacccgtctggcgcgaatgcgcggtcatcacgccggcaatcaactcatgctcacgtccgcccaaggtgaacggcccggagacgttgacgtcagccgtgttctgcacacgatgaccttcccagcgaccccaatacaaaaacatgccttcgccgctggcgcgatccggattgccaccgcttgccgaggccaattgtgtgtcgtggtcggtggttttctgatcgaggctgaccttgaacttccagtcattggccagcgcatgttcaagcgaggcgaagtaggtgatgttgtcgaaatcgcgacggctccagtcagcgccggaattgaagtggcgggggaagtcggttcggccgccgtcggcgaaatacaccggattgccggtccaggaggtgccgcgcggggtagtgctggacttgtcgatgccgaacgtcagcagcgtgtcgtcgctcagatccgcttcgaggatgccgtaaaacaggtcttttttctggctgtagtgatcaaggtaggagttctggtcggaataggcaccgacgaaacgcccgcgcacgttacccgaatcggtcagcgaaccggagatgtcgccgacggtgcggtaggcatcccacgagccgacggtgccgctgatcgaggccttgaattgcttggtcggcttcttgcggatcaggttgactgtggcggacgggtcgccattaccggtcatcagcccggtcgcgcccttgatgatttcgacgcggtcgatgctcgcggcgtcgtcaccgttgttcgggttctcgccgtaaacaccgtcgtacgggatgttgatgccgtcgtactggaagttggtgatcgccaggccacgcgcggaaaattcgctgcggtcgctgtcgtatttctgcgtcgaaacaccgggcgtgttgcgcagcgcatcgccgacgctttgcacgccgcgatcgtccatctgctgacgggtgatcacggtgaccgattgcggcgtttcgcgaatcgacaacggcaggccggtggccgaggacatgctgccagtggtgtaggcgtgagtgtcttcggtggtggcgccgagaccctcggcagaaatgttcgtggcgcccagttgcagggcggcggtttccgccgcgtgggcattgaggctcagcagcgccagcgccaacgggcacaaggcaaaacgaaaacggacgtacggcatggagatccctttgcatcaaatcgatcggtcgttgaagtgcttctgagggttaaccgaacgaaaaacacaaaagggaactgcccaagcaaaaatccccacatccctccctgtaggagctgccgcaggctgcgatcttttgatgttggttgttaaaaacaagatcaaccgatcgccgccttcggcagctcctgcattggggcgtttttcaggtgctgatgccgaggcgttcgtgccactgggcgagggattcttcggggtagacgtcgaattgtttgtccttggctttggcgtcgacctcaacccacggcgctttcgagccaagcatcatgtgcgtgtgctccggtggcacgggcagcggcgtatcgatggctgaggcaaatggatggatcagctccggccactgcgggctgaacagccacagaccgctgccgcacaatgagcagaaatgccgttcggcgctgctgcgatgagcacgcttgtcgccttcgtctttcatcttcgcgtggtagatggcgatgttcttgcggccgtgaaccttgagctaggtcgcgtcgccgcccaggttgatcgcgtagcctccaccgccttgggtcttgcggcagatcgagcagtagcaacgttgataagggtagggatgggcgctggtgagactgaaggtgacagcgccgcagtggcaggagccttctaagtgcatgacgggggcctccggtgggctgggatgggttcggttcagcctagaagagttgtggtggatgtgttgccgccatcgcgagcaggctcactcctacaatttgaaatgcattcccctgtaggagtgagcctgctcgcgataaacgataacgcggttgcactggacgcccacccttccccaagtcagcatgtccccctaaaaacagggatcaaaaacccatgcgacgacttccctcactggccgcactgcgcactttcgaatgcgccgcccgtcacgcgcattttggccgggccgccgctgaactgtgcgtcaccgacagcgccgtcagccaccagatccgccagctcgaagaacagctcggcgtttcgctgttcatccgcgaaggccggcagattcgcccgaccatcgccgccggacgcctgatgcagagcctgcaacaagccttcgaactgatcggcgatgcctgcgatgaactgcgcgatccgtcctcgctggcggtattgcgcctggccgtcaccgctgagcttgcgcagaaatggctgatgagtcgtctcagcgatttctacgcgcgctacccgcacatcaccttgcacctctacgaacaaccgatcgacgccagcgcccccggtgaagacatcgatctggcgatcacctacggcaccggcccggccgacagcagcgcttatttcgtgcggcccttgccggcgctgcagttcttcccggtgtgcagccccggcctgttcaaccagggcacattgaaaaccccgaaggatctggcccgccactgcctgctgcacgacgaccaggacggcaagacctggaccgcctggctgaccagtcacgccggcgatcaacgcccgcagcgtcagttgtatttcgcccatgcaggtctggcgctggaagccgcggcgcaagggcagggcgtggcgatgggtgacaacctcaccgcgcaggaggacttgcagagcgggcggttggtgcggccgttcccctggagcatgaccgcgctcggccaatacgcgctggtgtgtgaacgcgtgcggatggagcgtccggccgttgctcagatgcttgagtggttcaacgatcagctggctgattgatgagttgaattcaactgttccgcaataatcatcgttggcgagcccgccgccaacgcccgtaccttgtggtcattcctatcgcgaagacgaggtttgaccatggcacgtttgctcgactccacccctaaacacgacggcttccgtctgcccggcgaattcgaaagcaagtccggctgctggctcggctggccggagcgcaccgacgtctggcgcaacggcgccaagccggcgcagaaagtctgggtgcagatcgtcaccgccatctcccacagcgaaccggtcaccgtttgcgcctcggccgcgcaatttgccacggcccggcggcagttgccgccgcaagtgcgcgtcgtggaaatgacctgcaacgacacctggttccgcgacagcggcccgtgctttgtgatcaacgaccagagcggcgaagtacgcggcgtcgatttcgagttcaatgcttatggcggtcttgacggcggcctctactacccgtgggacaaggacgaccagattgccagcaagatcctcgaaatcgagcgcttcgaccgctaccgcgcaccgttgattgccgagcttggcggcattcagagcgacggtcagggcagcatcctcaccaccgaacaatgcctgctcaaccgcaaccgcaaccagcacttgggcaaggacgaagtcactcgcaggctcaccgattttctcggcgccgaacaagtcatctggctgccgcgcggctgcaaattcgacgaaaccgatggtcacgtcgacgacctcgcctgtttcgtccgtcccggcgaagtggtactgcaatggaccgacaaccgcgacgatcctcagtgggaaatctaccaagaggcctacgacattctgcgcagcacccgcgacagccgtgggcgcgagttgaccgtgcacaaactgccgcaaccggacgtgctcgaatggaccgccgaggaagccgaaggcctcgaccagcaagacagcacccacacccgtcaggccggcacgaaaatctgcgcgtcgtatatcaactattacgccggcaacagctcgatcgtggtgccgctgtttggcgatcgtcaggacaaagtcgcgatggcgacgctggccgaactgttcccgcaacacaagatcgtcggcatcgaaaactcccgggaaattctcctcggcggcggtaatgtcgcgtgcatcaccatgccgcaatacgccggcacgcctgtccacaagaagggagcctgaccatgcgcctgcacaaactgactcaagcgttattgctggtgcttgcacccttgtgtgtgcaggccgccgacaccgcgaaaccggtggtcaacttgtacatctggggcgagtacctggccccggataccttgaaaaacttcgaggcgaaaaccggcattcatgtggtcgccgatcactttgattcactggaaaccgtcgagaccaaactgctcaccgggcgcagtggctacgatctggtgctgaccgcaggccagcacctgtcgcgagccatcgaaagcggtgcgatccagccgctggacaaggcgcgggtgccgcatttcgccggcgtcggtgaggaattccgtcagcacatggcggtgttcgatccgggcaatcgttacgccgggatctacgcgtggggcaccacgggtgtgggctatcaggaggaggccgtcaaaaagcgcttgcccgatgcgccgaaggacagctgggcgatgttgttcgatccggcggtggtgtcgaaattcgccgattgcggggtgagtctgctcaatgatccgaacgaggtttttgcggcggtcatgaagtacatgggcctggacatcaaccggcagaaccttgacgacctgaaactcgccgagcagcaactggcgaagatccgcccgtacattcgctacttcgacaatgatttgaacatcagcgatctggccaacggcaatacctgtgtggcgatgtcgtggaacggcaacgtggcgattgcggcagggcaggcgcaggcggcgaacaagccgttcaaactcagttaccggattccgaaagagggcacgttgatctggtttgacgcgatggtcattcccaaggacgccccgcacccgcaggccgggctggcgttgatggattacttgatgacgccggaagtgatggcgccgatcaccgacaccattcactacgccaatgcgatcaccgcggcggatggtctggtcgatgcggcgatccgcaatgatccggggacctacccctcggccgacgtcagggccacgctgtacagcaaaaacgacaacggcaaagccttcaatcgcgcgttgatccgcgccttcagccggttgaagtccggtctctaaccccacatttgcccctgtaggagctgccgcaggctgcgatcttttgatcttgatctcaaaatcaaaagatcgcagcctgcggcagctcctacatgtttgggttttcagcacagtgtgaatcgatgccatctgacccacccctgaaccctgtaggagtgagcctgctcgcgatggcggtggttcagtcgatggggatgttgactggactggcctcatcgcgagcaggctcgctcacagggttcggtgtagcaaaaaacctgtgtggcttgccggcgatgaacgataacgcggtctaaaccttggcaacgcgccaaaggtaccaggcggcgacggttctgaacgggctccacttcaacccgatctcgatcatctgcttgcgcgtcggctgcacctccagccccttcagccgccgatagccttcacgcacaccaaagtcatcggccggcaggatatccatgcgctcaaggctgtagatcaacagcatctcgacggtccagcggccgaccccgcgcaggccgatcaagcgttcgatcagcgtttcatcgtccatcgccaatgccgtggcgtaatccggcaccacgccgtcgagcgtcgcctgggcgatcccttgaatcgtggcaatcttgcctgctgaaaacccacaactgcgcattcgttcaaagtcggtcgcgaggatttgttccggccgtggaaatgactgcgacggaaacagccccaccagccgcccgacaatcgcatccccggccttggcatgcagctgctgataggcaatcgcccgcaccagcgactcgtacggatcgcgtgccgggtgcggttggtgcaggcacgggccgaccgctgtaatgtgccgctgccagtcggagtcgaggctggcgaggtatgcgctggccgcttgataggcgtcgggcatgctatttcagcaagccgttgacttcgccgtaggtgaaggccttgaggtcgtgggtgtcgagtttgccgctggcaaggaagcttttcaccagcccgcccatcgcaccgtagaggaactcggcgatgccggagccggcgctcaggcggcgcacacccaaggcttgcagttcggcgggcgagggcaggcaggcgaagccgagcacgttgaccggcagcgtcgtgcctttgcagatcgcttcgatttcgtagcccgaggtgaccccggcggcgaacaagccatcggcacccgcggcctgatacagcgcggcacggcgcagggtttcggcgacgcggtcttcagccggcaccaggcctttcagatagacatcggtgcgcgcattgatgaacagtttgaccgcgcgtttgtcggcgacttgccgcgccacctcgatcttgcgcgcgagcagctccggcgtttgcgcgccgtcttcgatattgatgccgaccgcgcccgccgcaataaccgcatcgagcacctcggcgacccgcccgaggtcatcggaatacccggcctcgacgtcgacggtcaacggcacgctgatgacccgggcgatggattccaccgtcgacaccagccgttcgaggggcagcgtgttgccgtccgggtaaccgtgggcccaggccacggcggcgctgctggtggcgacggcctgaccaccgagctgttcgaccagtcgcgcgccagtggcgtcggcgacgttggtcagcatcaacaggccttgctggtgcaactggtgaaagcgggtgtcgagcgtgctcatcgaaattccttgttgttgatggggcaaaaatcgtcaaaaagccagcggttgggtgagctgcagtgcggcgttttccagcctcagcaagaatgccttgcgcggttgtcctccaccataaccggtcagcgcgccgtccgcgccaatcacccgatgacacggcacgacaatcgacagccgattgtgcccgttggccagcccgaccgcgcgactcgcgccgggtttgcccaacgccgccgcgatggcgccgtaagtgctggtgtgaccgtaagggatttgcagcagcgctgcccagacctgccgggaaaattcgctgccgggcaaatgcaacggcaccgtgaatacgttcagcgtgccggcgaagtaggccgccagttctttttcgatctgctgcaggtgtgcgttatgccctggcgcgaccgcgtagccatagcggctctgcaatgcttcaacttcgccggtcagcgccggtcgatcaagaaactccagcaacaccaatccacggcgttcggccatggcgatcatcggccccagcggcgtggtcagccgggtgaacagcagcggctcgctctgttcggcgcggcccggtgtgatgtggaacgacttctggaaagcgtcgcgaaaaccactgagcgagtcatagcccgagtcgaacgcggcgtgatcaatcgaggtgccttgtctgatcccgcccagcgccatgcccaaccgccgggtacgtagccaggcgtggaaggtcatgccgaaatgttgtttgaaccaacgccgcagcttcagcggctcgatgcctgcggcgagcagttgtgcatcgctccagcgcagctccgggtcggcgtccacagcgttgagcaggcgctgcacccaatccggggcgatggccgcagcgtccagtggcttgcagcgcaggcaggcgcgataaccggcggtcaggcattcatcggcgtgcgcgaagaactcgacgttctccggtttcggtttgcgcgccgtgcaactggggcgacagaagatcccggtggttttcacggccgtgaagaacacgccttcataggcggtgtcgcgttcgagcatggcgcgaaccatctcggcgtggggcggcaggacaacggtttgtatgttcatggcatgactgtaaaagcagattgtcgatggctccaccgaaaaatcgacagtgaatttccattacccctgaactaccgtgtaggagctgccgaaggctgcgatcttttgatcttgtttgtataaatcaaagtcaaaagatcgcagcctgcggcggctcctacaggtttgtgaggtgttggtttatgcatccgttttccattcagcgtattgatcatattgtcctgcgcgtgcaagacctgcagcgcagcatcgagttttacggtcaggtgttcggtgccgaggtggtcaagcgcaacgaaccgctggggctgatccatctgcgcgcgggcagctcgatgattgatctcgtcgacctgcaaggcgaactcggccgcaagggcggcggggcggccggtgccgagcggcgcaacgtcgatcacttctgcctgcgcatcgagcctttcgatgaagcgcagctgagcgcacatttgcagtcctttggtctgagcgttgccaaagccgagtcacgcttcggcgccgagggtaaaggtttgtcgctgtattgcttcgacccggatggcaatcaggtcgaactcaaagggccgcccgaggcttaagcgcgtttggccatcaacaataccgaagccgccgccgacagcagccccgcgcagcaacgattgaatatccgtttgccgcgcggctcggcgaaccagcggcgcatgtgcaggcccatccaggcataaacgctgatggcaatccattccagcagcaggaacagcacacccagtacggcgaattgtgctggcaccggtcgggccggatcgacgaactgcggcagaaatgcggtgaacagcaaaatcgctttcgggttgccggccgccaccagaaactcctgtcgcgccaaggcgaagaagccaactgtcgcccccgtcacgtgctgctcggcctgcggatcggcccgccatagttgccaggccagatacagcaagtacgccgcgccaatgatcttgatcgcatggaacagccattccgacgtctgcaacaccaccgacagaccggcgccggccagcgcgatcatcccggcaaacgccagaatacgcccgatgcccgccgtgcaggcgcggcgaaaaccgtagcgggtagcgttgctcaccgacagcaggttattcgggccgggggccatgttcagagcgaagcaggccgggagaaacaggctgagggtggcgagatccatgacggcactccagaaacgagaaggccatttttatcacagcccacgcgccgccagacccatacagtcaggccccgctgtcgcggtacagcgcccggctgtgcaggacaacgccgtcgaactttttgctgacggcgcaactctgaaacagtcagagggcgatggtttcgtccgaaaaagttatccagccggtcagaaataccgattgccgtgtaacatttgctccctgtttctgctccctgtttcaaacatcccgcacggcccaggcggccccaccaagagcgatctacatgcaagcaaaggcccgtgaagtttatgtgccaccggtgctgcaagatctgcgggccggcactgccgaactgcacatcgcactggaaaaacgccttccatttttctccgatactctcgataccccagcatttgtgcagttgatgcaggcttattacggcttctatctaccgttggaagacgcgctgctgagcagtggcgcgattcccactgattttgatctgacgccacgactcaaggcgccaaccttgcgcgccgacctgcatgccctgggcttgagcagcgaggcgctggcacgtctgccacagtgtgaagacttgcccctgatcaattccgcggcttgctgcctcggcatactgtatgtgctcgaaggtgcgacgctgggcgggcagatcctgcgccgggaaatcgccagccgactcggcctggaagccgacaatggcgcggcgtttctcgatatctatggcgccgccactggccgctgctggcgcgatttcattgaatacctgagccgtcgaccgatggatgcggacgagcgcaaggccgtggttacggccgcacacaccacattcagctgtttcgagcgctggctcgaaagccgggaggtactggcatgaccccgcaagacaaagaagcctttgaagaactgctggccaactgtgccgacgagccgattcgcttcccgggcgcgatacagccccacggtttgctgctgaccctgagtgagcctgcgctggagatcgttcaggtcagcgccaacgttgcaaccctgctgaaccgtgagccgctcggactgatcggccagccactggcgcaactgatcggcgacgccgaggccgcgcaagtgcgcgaagccttgctgcagccggcgttgtccgacacgccgccgctgcactttcgcctcaatggcacggcgttcgatggcttgctgcaccggcatcagggcgtgctgattctggagttggaaatccacgtcgaaaacttccagccacgcaatgtcgccggcaaccagacccatctggggcgcatgctccagcgtctgcacgcggccacctcgttgcaggcgctgtacgacatcagcgtcaaggaaatccaggccatgaccggttacgaccgggtgctgatctatcgcttcgaagaggagggacacggccaggtgatcgccgaagcgtccgacccgtcgatggaagtgttcaacggcctgttctttccagcctcggacattcccgagcaggcccgcgagttgtatcggaccaattggctgcggatcatccccaatgccgattaccagccagtgccgttgctgccgaagctgcgcccggacaccgacacaccgctggatttgagttttgccaccctgcgcagcgtgtcgccgatccactgtcagtacatgaagaacatgggcgtgctttcgtcgatgagtatctcgctgctcaagggcgacaagctctggggcctgatcagttgcggcaaccgtcagccgctgcacgtgccgcatgaattgcgcgcggcgtgccagaccatcggccaggtattgtcgttgcagatcagcgcgatggaagcgctggaaatcagccgtcagcgtgaagaaaaagtcgaggcgctggctctgctcaatcaagcgatgatcgattcgccgcaaaacgttttcgatggcctggccaaccagccgcaagtgcttatggcgctgaacaacgccggtggtatcgcgatcattgaagacaaccaattgcaccgttacggcaactgcccggagcctgcgcagatccgcgccctgcacaagtggctgcaggacagcggcgagccggtgttcgccagtcataatctggccagcgtgtatccaccggccgccgagtatcagcaagtggccagtggcgtgcttgccatgagcctgcccaaaccggtcgacaacggcgtgctgtggttccgccccgaggtcaaagagaacatcaactggagcggtgatccgcgcaagccactggacctggaaaactccgacgcaggcttgcgcctgcgcccgcgcacctcgtttgaaatctggaaagtcgagatggccggcatctccaccaagtggagccatggcgatctgttcgccgccaacgacctgcgtcgttcggcgctggaaaacgatctggcgcgccaggtgtgccgcgaacaggaagccgtgcgcgcccgcgatgaactggtggcggtggtctcccacgacctgcgcaacccgatgaccgtgatctcgatgctctgcggcatgctgcagaaggcgttcagctccgatgggccgcacacctcgcggcgcatctccaccgcgatcgacaccatgcagcaggcggccgggcgcatgaacacgctgctcgaagacttgctcgacacctcgaagattgacgccgggcgctactccatcaccccgcagaaactcgacgtcgggcagatgttcgaggaagcgcaggcgctgctcgcaccgctggcgctggacaaggacatcagcatttcctttgccgctgatcccgatttgcgcattcacgccgatccggagcggctgtttcaagtgctgtcgaatctggtcggcaacgcgatcaagttcaccccgcgcctgggcaccgtcggcgtgcatgccaaatcagtcggcgatgaaatcgttttcaccgtgcgtgacagcggcgaaggcatccccaaagagcacctgccgcacgtgttcgaccgttactggacggtaaaggaaggcaatcccaacggcaccggcttaggtttgtacatcacccaaggcatcgtcgaagcccacggcggccggatcgtcgccgagagtgagccggggcagggcagcgaattccgcttcaccgtgccacgcctcgactgacccctgcaggagctgccgcaggctgcgatctgttgatcttgtgtgatcgttcccccgctccgcgtgggaatgcctcaacgtacgctctgcgttcggctctggaagggacgcggagcgtcccgggctacattcccacgcagagcgtgggaacgatcagatcacaggggcattttcttcaataccggggattgggcgctcgataccgtgagcaccttgttccttgggttgaagcgggtgtgcgatgagtctgattgtttcgatggcggcgtttgcgttggcggcgtcgatcacgccgggaccggtgaatatcgtggcgttgagttcgggggcgcagttcggcttccgcgccagccagcggcatgttgccggggcaacattggggtttgtgttgttgctggtgttgatgggcctgggcctgcacgaggttctgcaactgtggccgttcatgacccgcgtggtgcaactggccggggtggcgtttctgctgttcatggcctggaaactggccactgacgacgggcaattgaacgccaaggatgccgcgcgggcgccgtcgatgctgtacggcgcggtgatgcagtggctcaatccgaaagcgtggctggcctgcgtggcggggatgggcgcgttcgtggcggatggcgaggcgcagctggtctggcagtttgcggcggtgtatctggtgatttgctatgtgtcggtcggctgttgggtgtatgccgggacgtttttgcgtgggtatctgagcaacgcggcggggatgcgctggttcaatcggagcatggcgctgttgctggctgtcagtgcgatctacctgctgttcacctgaccctgccacaacctttgtagcggatcggtcagccgcgatattgcccaggtgttgcggccagatgctgtttgaaggcccgctgaaagtgcgcctgatcggcaaacccggccgccagcgcaacatcggcaatcaactgaccgctgcgcaaacgctcgcgggcgaactggatgcgctgattgaccagaaacgcatgcggggtcatgccgtaatgctgcttgaacgcgcggatcaggtacgacggtgacagctgcgctgcgacgcagatgtcatcgaggctgagcaggtcggtgcaatgttcgcggatgaaatctgcggcgcgctcaagtttgaaattaggttcgcgcaacgcttgcccggcagggttcaggtgcagttgcagatcgctgaaaaactccaccgctgcgctctgcttgcgtagtacatcctgttgctcgtcgatcagcacttggtaaagcgcgatcaagtcgtgaaacagcgctgcatcctgcaggtgcgtggcagagaacggtcgaaattccagatccttggcaaagcccgactgatgctgcaaatccgtcagccacggcgtctcgacatacaacatcacgtacgaccacggctgatcatcaatcggattgcaggcgtgcacatcgccggggttcatcaacaccaccgtccctgccgccacctcgaattgcgcatgctcgtgcacgtaagtactgcgcccggcagtaatcgcaccaatcgagaagtgcgcgtgggaatggcgggcgtaacagacttcgcggccatcggcgatggcccgcgcttcgatgaagggcagggcgtcgtcgcgccagaagcgcggggctttttcagggtttttggcggcagcgtgtttcattgtgattattcccggcaggccagcgcccgagtgtattagctctggccggcaaaggctcgttccagttcggcgatgtcgagttttttcatcttgaacatggcctgcatcgcccgctgcgacttgctggtgtcggcgtccagcatcatgtgcatgaacgccaccggcacgatttgccacgacacaccaaacttgtctttgagccagccgcattgctgggcttcgaccgggccaccctcggacaggttgccccagaaatggtcgacttcttcctggttctggcaattgacctgaaacgaaatagcttcgctgaacttgaacatcggcccaccgttgaggccggtaaacgtctggccatccagctcgaaactgacggtcatcaccgcaccttccggcttgccgtgaaattcctgaccgaccttgctgtagtgggtcagaccggtgattttcgcgtgatcgaagatcgagcagtagaacttcgccgccgcttcggcctgatcatcgaaccacaggcagggcgtgagtttttgaaagcgttgcatggcagttatcctcggcaggtcagacacgctggactatcagcgtagacagtccttggtcgactggcagcgccgtagatcgacaagttgccggctcatcagaaatcccagcgcgccgtcagttgcaggctgcgcggttcgccatagaacccggtgccgaaattgccgagtccggtgtagtaggtcttgtcgaagaggtttttgacgttgagcgtagtgctcaggtggtcgctgaagcggtagcgtgccatggcatcgaccaggtaataactgtcctgagtgatgcgtacgttctggccggcatcgggctgaaagacgttgccgaaaaattcgctctgccaactgatgccgccacccagggtcagattctgccagacaccgggcaagcgatagctgctgaacagccgtaccaactgctccggcgcggtggtttgcaggatcgatgcataaaccggattgccctcggcatcgcgggtgtggttgtaggcgtaaccggcagaaagattccagccgtcagcgatttcgccggccacttcgaattcgaaacctttggtcgtcgcaccctctacggcgcggtacacggcctgcgtgtcgaagccgctgacctgctcggcgacgttgtcctgctcgatgcggaacacggcaagactggcgttgagccggccctcgaagtattcggcttttatccccgcttcatagctgtcgccttgcaccgggtcgagcaactggcgcgcggcgtccttgctcagttgcggctgataaatgcgtgtgtagctggtgtacagcgagtacgtgtcgtcgaggtcgtagaccgcgccggcgtagggtgtgaccacgccggtctggcgatagccctcgcggacattggcggtgttcgggtcgtgatagtcgaggtggtcgctggcgctgaaatcgctgatacgggcgccgaggatcagcgccagatcgtcgctggccttcaagcgcgtcgatacgtacgcgccggtctggcgttggctgatggcgtcggtgccgatctgcgggatgtcgggtttggcgaactcgccgtgccagtcgaaaatgctggcgttcagcgccggataaaccgagccgtacacggggttgtcctgacgggtgttcatcgacatgaacccgacgatcatctgatgctcgcgcccgaacaggctgaacggcccgccgaggttgagatcgacattgtcctgcacttcgtcacccttgaatttgcccatgtacaggaacatgccgtcgcccgtcagcggatccggattgccgccactggcggagccgagcagggtgtcgtgctcgcggtgtttgcggtcgtagctgagcttcagcgtccagtcgctttgcagttgccgggtgagggcggcgaacagcgtctgattgctgaaatccctgcggctccagtcggtcgccgggttgaacgagcgcgggaaacgagtccgcgtaccgtcgctgtagaacatcgggaaaccggtccagctggcgccgcgtgagcgggtgttctgctgatcgaaacctacggtcagcagggtgtccggggtcagatcggcttcgacgatggcgtaggcgatgtccttgctgttctggtaatgatcggcgtgggcgctgcgttcctgatggacgccaacgaagcgcgcacgcaggttgccgctcgtggttaacgggccggagacgtcggtctcgctgcggtagttgtcccatgagccgacgctgccgctcagtgatgccttgaaagcttgcgtcgggcgtttgcggatcagattgaccgtggcggagggatcgcctgaaccggtcatcaagccagtggctcccttgatgatttcgacccggtcgaaggtcgccatgtcggtgctggtggtgccgtaatcgtagacgccgtcgtagtcggtattgacctcgtcgtactggaaattggtgatcggcgcaccacggctggaaaactcccaacgctcgctgtcgtagttctgcacgctgatgcccggcgcgcggcgcagcacgtcggcgatgccggtggcgccttgatcgtcgagttgctggcgagtgatcacgctgatcgattgcggggtttcgcgcagggacagcgccaggccggtggcggaagaggtctggccggtggtgtaggcgtgggtgtcttcgctgatggcaccgagggttttgccgttgatggtggtggcgtccagttgcagcggttctgcagtggcggcgctgcgcaagacataaccgccgccgctttgtggttgggcttgcaggccgctgcccttgagaagaatttgcagggcttgttgcgcagagtattcgccgtgaagaccggggctgcgcttgtcggcggccaagtcgttgtggccggcgatgaacacgccgctctgttgcgcgaagcggttaagcgctgaagccagtgagcccgcagcgactgaataatgctgcttctgcgcctctgcttgcgcagtcgacgcactcagccctggcacggcaaatgccaagaccaaggcgaaacgggggcgggcgagggggcagcgcaacatgcagttttccgggacgcgagcaacgaagtgcgggctgttgtgggttaaccgaatgaacgcgcgaaaagggaaccgtgaagtgaaaaaaacctcaggttttcggtccgacgctaacccaccagttgaaagtcttgtcgacgcgaatcggcaatgccgcttcgagcaggcgcaaggcctgatcggtatccttgagcgggaacgaacccatcactggtaagtcggccacggccggatcgcaatgcaaatgccctggacggtagcggctgagctcttcgatcagctcacccagcggcaggttatccgccagcagcagcccttggcgccaagcctcgcgtgacgggctggccgtggttgcggtacccaatcgagccatgctgaatgtcaattgctggccggcctcaaccacttgagtctggccttgctggttgcgtacttcgacggcgccttcatagacgttgagcagggtgttgcgatcgttctggcagacgctgaagcgcgtgcccaatgcgcgcatccggccatgttcggtgtccaccagaaaagcccggcctggatccctggcggtgtcgatcagcacttcgccggcgcgcagcagcagcaagcggcgcgtcgcgtcgaaatgcacattcagcgtgctcaacgcattgagccagatccggctgccatcgctcagtgtcgtttcgcgggtttcgccagtgccggtcgacaggtcggcacttagccgttcgatcagcggtgtgctgcgccaggcggccaaaccggtcagcccggtcgcggcaataatcaacaggcccttgagcgattgtcggcgactgatcgaggcgcgactgctggtccgcaaggcgtggctgatggcgtgagtttcgctgtcgctttgcagtggcgcgaacctttggccgacgcgttcgacatagctccaggccgcctgatgctcagggctttgtgccagccatgcctgccagcgcagctgttcctgatcggcgaccggcgcgtcatgcaattgcacgtaccagtgcgccgcctgctcaaggctggcgtggctgagtttgttcatggcgttactcaatcagcaggccgtcgagttcggcctcaagaatcgcgcaatgcatcatcgcttgggcgaggtattttttgatcatccgctcgctgacgccgatctgttcggcgatcaatcggtaaggcatgccgtgcaactgcgcaagaatgaacgcctcactgacccgctgtggcagacgctgaagcatggcatctacctcgtgcagggtttcaacgatgatcgcctgctgctcgggggagggctgcaaggctggcgggcggctggcgagggtgtccagccaggtctgttccagttgccgacggcgccagtgatcgacgcacaaaccgcgggcaatggttgccagatgtgagcgctcgtgaacctcatcagtgaagatttgcgggcgcttgagcacgcggatgaaggtgtcatgggcgaggtcggcggcatccattgcgttgctcaggcgtcgacgcaatagctcgtgcagccagcggtggtggctgaggtagagattctgcacaagtgaggagtcggcgaccgtcattagagcaagcgtccagaacgaccgtgaccggtctaaatgggaatgggtcgcgattaaaacaaaaggcaggatagtgtgcaaatgatattggtttgcttttagccgtcgtgtacgagatttttgtgagatgtggtcgtaatgactttgtgtcgagtcaaaatgacctgtttctttctgtgtcaaattgactctttgcagtgcgggtgcccggtttcactggcttaaaaaactggcacaggatttgaagtacttaacgtacccatcgaaccgatcaggagtacgccaccatgttcaccttcttcgaaagcccgctgcacgttctgcacctgtcgagcaaagtcctcgtcgtcggcctgatcatgttgctggccggcatctttggcgcctacctctacagcggccccatgccgattgccctgcaggtggcgatgcatgcgctgaccatcctcggcccgaccctgatcaagatcggctacgtcatgcgcctgctggcgcaataccgcctgcgcgggccacggttgatcccgcaagctgcctgaccttataggaacagctcggctcctacactgtccggtggtatatctaaaatccaaggtcaacccaaatcccctgtaggccttcgcctgctcgcgatggcgtccgcacagtttgaatctgtattgcctgacccaccgctatcgcgagcaggctcactcctacatgggatggtgatgtttttgaaagtcagcgtcgctcagcgaccatcagtagcgcctgcggcaccgggctttgtgggtgttggggttcctgcagactgatcaggcggaagccggccatgtccagcgcattgaaccagctcgacaacgtgcggaaataccacggcatcggctgccactggcctttgaacccggcgaacgattcttcgcgccaaccatcttgataatcgcctgccgctgccgcccatggatgcaatgtctgaatcaccagcgcaccaccgggaaccagcagcacattcatcgcggccagtagaggaataatgtcctgatgcagcagcgagaaattcgcgcagatcaaatcgaagtcacaaccgatatcagccttggcttcgaccagcgcgtcgtagtcggcgacatgcacggttggagaaccggccagacgcgccgcttcaaccagcgtcgcatcaccgtccacgcccaccgcagcaatgcccaggtccgccagcgcccgcaacaaccagccttcgccgcaacccagatccagcacatgctccggctggcggcccatgatcgccagcagaatcgcctgattggtcacctgttgacggctttcgatggcgccgctgcggatcacctcgatccaggcatcagcgttgtcgtgccagctttgtagaaggctggattcgggggagggcatggcggattcccgacgattgaaaaaaccagtatggacgctgatcgcaagctagggcttgtagatcagcgcatccaccacaaccccgaacgccgacgaatgctcacgacgattcgggtaataaagatgatagccggcaaagggctggcaccagtcctccagcacccgcaccagactgccgtcggccagattcccggcgaccatgtcttcgggcagaaaccccagaccgcatcccgccaccgctgcgcgcagaatcggcacactgctgttgaacgtccattgcccttcaacgcgcgccttgagttcgtgaccgtccttttcgaaatcccattgcatcaggctgccatgcgtcggcagacgcagattgatgcagttgtgcgcggccagatcaccgggctccaagggtattggcctgccgttgaaatactctggcgagccgacaaccgcgatacgcaacgacggaccgatgggcacggcgatcatgtccttggccacctgatcgcccagccgcacaccggcgtcatagcgttgcgcaacgatgtcggcgagggcgtaatcgacggtgatttcgactttgatgtccgggtaatcgggcaacaccttcagcagcttcggccagagaatattgttcgccgcatgctccgacgcctggatacgcacattgccggccggggtgtcgcgaaattcgctgaccgcggccagttccagttcgatctcgtcgaagcgcggcgccatcgattgatacaagcgttgaccggcctcggtcggggaaacactgcgggtggtgcgcgtcagcagacgtacgcccaatcggctttccagcgcgcgcatggtgtggctcagcgccgactgcgagacgcccagttgcgcggcggcgcgagtgaagctgccttcgcgagtgatgaccacgaaggcttgcaggtcgttgaggttggcgcgggacattgatgagaacctctcatgaggagcgcgtgattattccatgtaagcaggtcgcgcacggatgcgcgaccctcaaagcgctcatcacagggtgcgtgcgtagaactcgctcagtttgccgatcgccgcatcgacataacgcggcacccaataggtttcgatatgcgtggcgccgtcgaggataaacacttccttgtcggtcgtgccggtggctttggggaacgcatcctgagtcatgtacaggctgtcggccttgctgccggcgatcatcagcaacggttggttgatcaactcgatctgatcggtggcgtcgaaccgcatcaagtcgatcaggctgctggtggtgtatttgaaggtcgagttcgggtgcgcgtgagtcttccagtagtactcgtagccttggcgatacagctcgaagggcagtttcgcgatctgctcatcggtgaggttggcatcaccggaatacaacaccgtgccgccggccgcttcttgcgcgcgggcttctgacgcctgttgcagacgttgctggatgctgtcgatttgcgagtcgttgtagccgttgcggcgtacccggcccgagttgaacatgctcaccgtcgccagcgatttgaagcgtttgtcggtttgcgccgccgccaacgaataaccaccgccgccacagatgccgagcaggcccagacgcttgtcatcgacgccggcaaactgactgatgaagtcggccatgccgtggatgtcttcgatgcgatatggcggtttatcgatgctgcgcggctgaccaccgctggcgccctgataggccgcatcggcggtgatagtgatgtagccctgttcggccaggcgctgggcatacagaccggcgacttgttcttttacgccgccattggggtgtgcgatgaccacggtcgggtaggtctttttcgcgtcgtaattggccggggtgtaaacgttggcggcgatgtccagaccgttgagcttgtagctgaccgggtggatgttgaccttgcccgcttcgttcttgctgatcgcgccgtcgtaggcgagggtaaacgggttctttttgtagtcggcggccaaggcttcgccgcccgagaggccgaccagtgccgacatgagcgtggctttgagggtgtttttcacgtgaagctcctgagcaataaaaagggcggcagttcaaacgaagggcgggtcaatccagctgtttttctttgaggaattgcgccaccaggtcagcgatctgcacgttgttcagatccgacatggagaagtgggtgttgccgtggatgccaatctccggcagatggatcaggcgcacatcgccgccgtggcgattgaccgcatcacgccacaggcgggccatcttcaggcgcgcgcgccaactgtcctgcgcgggcaggtcgaccgcctgttcagggatgttgtcgccgtagaggatcagaatcggaatgcgcgtcagggccatgaactgctccatcggcaccgctgcgccttgcaccgtgtcgaacgcgctggggatcggcgccggcacttcaccttcggcaaacacgaaactactacccggctcgaacgccacgatggctttgaccttgtcgtttttgatcgctgtcaaccagcccggcccgccaccttgcgaatgtgtaaacaggatgccggggccgattttatcgaacagcgccgccacaccatcagagaccacgcccatgtcgaacggtccggtgttcggcgtcatcgcgcggaaaaactgctcgcgggtctgggcgtcctgtgccacttgcacgccgttgaagtagcggggccacaggccgatgcggaactggttgaaccacagttgttcgtccggcaccggtttgattgtggtctcgaccatgctgcgcccggcgtcgccacgccgtggttgattgatcagataaacgccgtagtggcgacgcaggaaaatgttctgaaaaccttcgcggccatcggcggtggtttcccaggtcttggaaaactgacccgcgccgtgccacatgacgatgggcagtttccgcgcgtcggccgggatctggtagaacgcgtaggcgtgatcaccgtgataggtctgaccgtcgggcatcatcggtttgcgtggatcgaatgtgcccggcgcggtggtcatcgtgccgccagcggcgaaactgccttgcttctgaatcagcaacgggccttcgggatggttcgcacacgcggccaatgcgccgaacagggtgatccccagcagatgttttgccgatttcatgtcattttcccgaggccgcgacggcctgggtcagcgcggcgttggctcgctcagctgtctgcgcatcgccatgttttttcagcagttcggtgacttggcgcaactgtgccgcgctgagcccgacgcgcaggctcgccgccatgtgcgagcgcagttgcgattccacgcccggcgtcgctgccagcgcgccgacggtggccagttcgcggctttgccagtcgaggttgtcgcgctcgaagatatcgccgaacaggtgggtttgcagaaactggttggccaccggcgcgaactcgaataccgggcctttgaccggcgcaccggagatcttcgtttgattcgcggtgccggcggccagcagctcatcaccgactggaattgcccggcccggctcacgccccggcgcatcttcgatgccgcgttgtttgcgcgcctgcaccacggtcatcagctcgttcaaggcatttaggctgcgcgggaaaccgacgtaggcgtaaagctgtacgagaatctcccgggtttcgctgatgctcaggccagcatcgagaccttgattgagggctgcgttgaggttgggcatgtcgctggtcgccatgaacgcggcgatcagtggaatggtttgttgtttatccgacagtgctgctgtgttattaggcgtgctggtcatggtttgcgatgcctcggctgcttgagtggtaacgctgaatatcgccccgacgctcaggcagagcgccatgagtgcggggacggcagtgcggttgcgtgcgtcagtgttcatcgtgaaaggctccatccattgcaggtcactgcggtgtcgctggatcgtacggaggatggttggggcgattaaccccgaaaatgcgcatggactcctgagtagtactcatgagtgggctttgcaataactgctgaaatcccggcgtaaccccgcagctgcggggctttgaggtcgtgtggcaatttctgggacagtgccgggcgagatgcttcgacacattccgtaacttcattggcctgcgtattgcgcctctgaaacctgttctgcccaagtgacggtcttgccatcctcggcttcagcgatggcgatgtgggtcatgccgttgctggcggaggcgccatgccaatggcgggtatgcggcgggatccagacaatgtcgcccgggcgaatctcctgacgcgggccaccttcttgctgcacatagccgacgccagcagtgacaatcagcgtctggcccagcggatgggtgtgccacgccgtgcgtgcgccgggttcaaaggtcaccgtgccgccaccgatgcgcgctggcagttctcctttgaacaggccatcgacgcgtacggagccggtaaagttttccgctgcgcccttgatcgagggctgagcgccgttcggggtaatgcggatttcgctggcggccccggcctccgcggtcatgagcgacaaggcaacaaatggtgcaattaatcgattcattggatgaactccggtcagacagtgaagtgatccgtgcagggaatcgccgtggcagggcaagtgatcgcctagcccttgagagggttatccgatagccagccgtttacgcgttccatggttctgcgctcctgctcgccctccattacaaaaccttcgatcagcctggcattgggcgcgtgctgttcgaggacactgcggctattgcccaaaccatatccaccatgggtgttgaaggggatgagggtcttgccggtcaggtcgtgggtgctgagaaaggcacgcacgatcggtggggcggtttcgccccagatcggaaaacccagatagatcgtgtcgtagtcgctgagggcgtgaaccctgttttgcagctcgggttcgaagccgctgtcgcgctcctgacgtgcctgctccacggtttgcagatagtcctcggggtaggcgtgggccgggcgaatctcgaacagatcggcacccagtccacgctgaatcagcccagcgaccacgcgggtattacccgagcgcgagaagtacgcgaccagaatccgcgagcctgagcgcggtgtttcactggcactctgcgtgtcggcgagcgacagcagcggggcgctggccagtgcggcgattaccgtgcgccgcagcggatcgtgatcgtggctcatcggccgacgcgcgccttgagggcctcgggataacgctcgccttcgatgcgaatctgtgccagcgccgtatcaatggccttgagttcggcggcgtcgagggtgatgtccgcgccgccgaggttttcttccaggcgatgcagtttggtcgtccccggaatcggtacgatccacggtgcctgcgcgagcagccaggccagcgcgatctgcgccggtgtggcttgtttctgcgcggcgatctgacgaatcaacaccaccagcccctgattggcttgcagcgcggactggctgaaacgcgggacgatgctgcggaagtcatcgctgccgtaagtggcctcggccgacaccgtgccggtgagaaaacctttgcccaatgggctgaacggcacgaagccgatgcccagctcccaaagcgtcggcaggatttcctgctcgggctcgcgccaccacagcgaatattcgctttgcagcgccgtgaccggttgcactgcatgggcacggcgaatggtttgcgcacccgcttccgacaggccgaaatgcttgaccttgccttcgctgatcaaatccttcaccgcgccggcgacgtcctcgatcggcacgtccggatcgacgcggtgctggtagagcaaatcgatgtaatcggttttcagtcgacgcaacgaaccctcgacggccattcgaatgtgctcggggcggctgttgagaatctgctgcttattgtcatcgccgaaggtgaagccaaacttggtggcgatgaccacttgatcacgaaccggcgccagcgcttcgccgaccacctgctcgttcaggtaagggccgtagacctcggcggtgtcgaagaacgtcacgcctcggtcaacggctgagcggatcagtgcgatggcttgttgggtatccgtggccggaccgtagccatggctcaggcccatgcagccaaagccgagggcggatacttcgagtgaactgttgccgagtgtgcgcttgtgcatgtcgatctcccgttgggcgtggggagaacagtaagcgaggtgactggtgaggactagacgggtaaaacgggatggcttgatgagtgttgttcattaatcgacagagggggcaaacgcgaaagtgagggggtactccctcacttattccgtgtgttggctactgcgggatgcgcagcttgtccagcagacggttgaccaacagctcgttcagcatgatcacctgttgcagcgccagcagcggtttgcgctccgggccgcctatcgagttggcgatgttaccggccatggagtgggcgtaggaaagcgactcacaggcttcgaccaacagggtttcttcatccagcgtggggtcgaccagatagaccgggcgaaatggaggcgagcttggtggagcacccagtgcttcgggtcgcaggtagtagtcgagggcgcggtcggtggcttctttgaccttttgcgggtcaagcgcggggtcgtgagggattggatcggtgtctggcggatttggcgtgattttgaacatagataaagctccaatttgaaaaaatgggagccatcaccctcgctaccaaacggcgggtggcggccatgcgcgggttggtagaccggtcaaattgggtaacccggcgctcacggatgagccccacgcatgcccaccatacaaagccatacctcaaaaaaaggagacagcatcgacggtgtcgcaacaacgacaatttaaagcaggctaccaaacccgatcactgttttgcagtgacaggccaacgatatagcccggcccatagccgtgtaagccggcggattctggcgtacgcgtaggtaacgacgcaaggtgttgtagggaggatggcgtaacggtttgtgtgctttaaacgcgataaccggatgacgtttaccaatgggcattgccgagcaatgagatctaaattcaggagttttacggactacaattttgggtgtgatgacctacagatctgcaagaatccgccgacttgtctgccttgaaacaagatcctatcgtttgccggtcaaaacttaatcacttaagctggtcagcatgaatacacaaccttcggaggctccgatggccaccaccagaaagaccgacaaacctaacaaaaaggaagttcgtgatgagctgacattccttgatgttcggcaagccgcgcgtgatgggcagaaagtgttcgataaatttgtgatcactggcaggctacctattacaaagtaggcctgaatgccagccatcaagatttctgcgctttttgaaaaaatcactaactggcaaaacttcgctgcacatttttataactacaaggtgtgcggtgaattacccgggattttcgggcgtgacgaacgactcgatctgaccgatatgcaccatatccaccttgccagtacttcgtcactgcaagctcgatgggcaaaaataaatcgtcagtattaccgcactgtattggttgacgacgctgataatgacttttggctgatctatgcctatgacgcgtttcgggatgaatatctgttgctgacggtcacgggcccggatgcgcataaccgaagcgagtggggctcatttctgcgcaatgtgcattgccagattgttgagccttggacgctgggcaggattgcctttcccgatttggacgatctgtaatttgcagtcgagcagaggaggtgtcatatgaatcgattgactggcggttgcctgtgcggcgatgtccgttttgaagtggcaggtcagccttatcgcgtcggtatctgccactgcctcgactgccgcaagcgccacggcgcgctgttcggcacctcggccatatttcccgaggatgcgttgagggtcaccggcgaaacccgcgactataacgggcgctttttctgcccgcgctgcggctctccggtgtacacgcgttcggcagatgaagtggaggtcaacgtcggatcgctcgatgagcctaatcagttcaaacccacttacgaactctggaccattcggcgcgagtcgtggctaccggcgctgccattggctcaccactacgagcgtgatcgtgaaagcacaagtcgcacagaagaataatggacgtgagcccaatcacatcccccttgtgggagcgagcctgctcgcgaaagcggtgggtcattcagctcaagttcaactgacagattacattcgcgagcaggctcgctcccacaggggggaagtgtatggctgccaatgatttcagccgcgaataaaggccagtagatccgcgttgatcgtttcggcctccgtcgtcggcatcccgtgcgggaaccccggatacgacttcagcgtgccattgggcagcaacttggctgacaacggtcccgagttcgcatacggcacaatctgatcatcctcgccatgcatcaccagcaccggcaccgtgaccttcttcaagtcctcggtgaaatccgtctgggaaaacgccacgatcccatcgtagtgcgccttcgccccaccgatcatgccctgacgccaccagttggcaataatcccttccgatggcgtggcccccggccggttgtagccataaaacggcccggtcggaatatcccgataaaactgcgcgcgattcgccgcgagttgcgcctgaaagtcatcgaataccgatttcggcaacccacccggattgctttcggtctgcaccatcaacggcggcaccgcactgatcagcacacctttggcgacgttgtcctggccatgccgggcgatgtaatgaatcacctcaccgccaccggtcgagtggccgacgtgcacgacattcttgaggcccagatgattgaccaccgccagcgtatcgtcggcgtaatgatccatatcgtggccatcccagacctggctcgaacgcccgtgcccacggcgatcatgggcaaccacccggaagcctttgccgaggaagaacagcatctgcgcatcccaatcgtccgagctgagcggccagccgtggtggaagtggatcaccggcgcgtctttcgggccccagtctttgtagaagatttcgacgccgtctttggtggtgacaaatcccatgttcgcgactccagaccaatgtgatggataacccgcgcggcaagcgcggaccgttttgctcaggatggatttctgctgcgctggctcagtgcgagccgttatcaactgtaggattaaagtcgacatctgcatgaccggtggtcgcaacgtctggcttcgtacgcaaattaggctttgctgaaagggataagccgaggcgcgcgtaggcatcgatggccacagcggcgccccttcagaacaccgtgagtctgaggaatttccccgatgctgaccttgaatatcaatggcaaggatcaggagctcgatgtccccgcggacatgccgctgctctgggtcctgcgcgatgtcgcgcacctgaccggcaccaaattcggctgtggcatggcccagtgcggggcctgcaccgtgcacgttgacggggcgccattacgcgcctgtatcacgcccgcaaccgccgtagcccatggacaaaaaattcttaccatcgaaggcctgtccaccgacggctcgcacccggtgcagcaagcctgggccgaactcgacgtggtgcagtgtggttactgccagtcggggcagatcatgtcagccgcagccttattggcgaaaatccccaaacccaccgacagcgatatcgatcaggcgctctccggcaatatctgccgctgcggcacctatccacgcattcgtgcggcagtgaagcgtgcttcggaaatcggctgattttgcggggagatagacgatgaacagtcctgtatcgcgtcggggttttctcaaaggcagtgccgtgttgggcggcggtttggtggtggcgtttgtcgtccccggcggccacaagtttgcctatgccgccgagaacgaaggcaaggtgtttgcaccgaatgcgtttttgcgcatcgcggcggacaacagcgtcaccgtgttgctcgggcattcggagatgggccagggcatctggactggcctgaccatgttgattgccgaggaactggatgccgattggtcgaagatccgcgtcgaacactcgccggcgtcagctgcggattacggcatgccggggtttggcggcatgcagattaccggcggttcgacgtcgacgtggatggagttcgaccgttatcggctggcaggcgcgacggcgcggcagatgctggtggaggcggcggcgaagcgctttgaggtcgcaccgtcaaccattcgtaccgaatccggtgtggtgattgcgggcgataaacgtgcaacttatggcgagctggcggacgccgccggacaactgccggtgccggatccgaagtcgatcacgttcaaggaggccaaagactggaaaatcattggcaaaccgaccaaacgcctcgacacgccggagaagatcaccggccgcgccaagttcggcatggacgtgcaatttgaaggtttgatgaccgcgatggttgcgcgcccaccggtattcggtgccagcgttaaatccttcgaaggtgctgaggcgctggcggtgccgggcgtgcacaaagtgctgcaagtgccgacaggcgtggcggtgattgccgagcattactgggcggcgaagctgggtcgtgatgcgctgaaggtcgattgggatctcgggccgcatgcagacctcagcagcgaaaaattgctggcaagtttccgcaaactggccgccacgcaaggcacgtcagccagtcaggccggtgatgccaagggcaactttggcaaagccgcgaagaaaatcgatgtcgagtacagcgtgccatatctggctcacgcgccgatggagccgctcaattgcacggtgaagatcagcgccgaaaaatgcgaaatctggaccggcacacagtttcagacgctcgatcaaatggtcgccggcaagatcaccgggctgaagccggagcaggtcgaaatccacacggaatttcttggcggtggttttggacgcagggccaatccgacgtcagactttgtcgccgaagcggtgcaagtggcgaaagccgccgccatgccggtgaaaaccgtgtggtcgcgggaagacgatattcgcggcggttactaccgatcgatgttcctgcaccaggccaagatcggtttgggcgcggatggtttgccgtcgagttggcagcatgtgttggtcgggcagtcgatcatggccggcaccatgctggaaaaaaccatggtcaagaacggcgttgacgcgacgtcggtcgaaggcgtctctgacagcccttacgtcaaaggcctggccaatcatcaggtcgatctgcattcgccgcagaccgggatcaatgtgctgtggttgcgctcggtaggccatagccacacggcgtttgtcatggagtcgctgatcgatgaaatggccacggcggccggcaaggatccggtcgaataccgacgaacgttgctcaaggatcatcctcggcatctgggtgtgctcaatctggcggttgaaaaagccaactggaaagcgccgctgccggatggccatagcctcggcgtggcggtacacgaatcattcggcagctacgtcgcccaggtcgccgaggtgtcgcaggacaatctgaagattcgcgtgcatcgcgtggtttgcgccgtggactgcgggattgcggtgaacccgcagagcatcgctgcgcagatggagtcgtgcatcaccttcggcctgggcatggcgctgcacagcaaactgacgctcagggacggcgcggtggtgcaatccaactatcacgattatcaggtgctgcggctcaacgagatgccggtggtcgaggtgcatattgtgccgagcagcgacaaacccggcggcatcggcgaggccggtgtgccgccgaccgcgccagccgtggccaacgccgtgttcgccctgaccgggcaacgtctgcgtgagttgccgctgcaactgtcgggggtgtgagatgaaacgacatctagtgttgggcacggtgattctgttgggactgggcggttatgcctcggacctgtttgccgatgatcaggaagccttgaaagcctttggtacggtgcagaaagtcttccagagcccgcgttgccagaactgccacattcccggggatgcgccgctgcagttcgacgccggcattccccatgcgatgaacgtggtgcgcggcatggacggcaagggcgccgccggtttgccgtgcgcgacctgtcacgcggaaaacaatccgcccgccagttacggcccccatgcaccaccgggggcgccgcattggagcctgccaccggcggcgcacaaaatggcctggatcggcctgccaccggacaagctctgcgcgatgatcaaggatcgctcgagcaatggtgatcgcgattttgccgcgctgatcaaacacgtcagcgaagacaaactggtgctgtggggctggaatcccggggcagggcgcgcgccggtgccggtgccgcacgatatttttgtcgcgcaattcaagctctgggccgatgccggcgggccgtgtccggtggcggggatctgatgagaagaactcacgcggatttaacgctacgctgaagagtattgatgccaacggagtgtgcgaatgctggttcccggaaaacccgccaatgaggataaacgtcttcaagcgctgcacggccttgacctgcttgactcggcgccggaggagcggttcgaccgactgacacggctggccaagcgcctgttcaacgtgccgattgcactggtgacgctggtcgacaaggatcgtcagtggttcaagtcctgcgtcggcctggatgccactgaaacgccacgggatgtttcgttctgcggccacgcgatactgcagaacgaactcctgctggtgcccgatgcccgtgaggatgtgcgctttcatgacaatccgctggtcactggtgcgccgaatatccgcttctacgccggttacccattgaccgtgcccaacggcaataaaatgggcacgctgtgtctgatcgacaccaaaccccgcgaactcgacgatgaagagcgcgcattgttgcgcgacctggcggaaatggccgagcaagagctgaccgccgtgcagatggcgagcatggacgagctgacgctgctgtccaatcgccgcggtttcaagcagttggcccagcatgcgctggacgcctgcgcccggcttgatcggcccgcgacgttgctgtttttcgatctcaatgacttcaaacagatcaacgatctgtatgggcatgccgagggtgacagtgcgctgaagactttcgccgacgtgctgcgcattgcctttcgcgaaagcgatgtggtcgggcgtttgggcggggatgagtttgtcgcgctgctgacggggtcgagccatatcgaaaccacggcgatcatggcgcggctcaaggaaatcctcgaagagcgtaatgccacgctgcaccggggctatgcgattcgcttcagcgtcggccagatcgaatacgacgccaaacgccatgagaccgtggatcgcttgctggcggatgcggatggggcgatgtatgcgcacaagcaggccctgaagggttgctagtgaatgcaccgcagatcctctgtaggagtgagcctgctcgcgatagcgtccagtcattcaacatcttcatagcctgacccaccgccatcgcgagcaggctcactcctacagaggtgtcgggtgatctcaaaatcccggttcgccgcagatccatgtgggagcgagcctgctcgcgatagcgtccagtcattcaacatcttcattgcttgacccactgctttcgcgagcaggctcactcctacaggggggggcgggtgttcacaagatctcggttcaccacaaatccaagtgggagtgagcctgctcgcgatggcgtccggtcaggcaacatcttcattgcctgacccagcgctttcgcgagcaggctcactcccacagggggacagtgttgcaggcataaaaaaacccgcctgaagaggcgggttttttattggctaagcgaagatcactcttcgatgttgcccatggcggtggtgttgaagccgccgtcgacgtacatgatttcaccgctgatgcccgacgccaggtcggagcacaggaaggcgccggcgttgccgacttcgtcgatggtgacgttgcgacgcagcggggtttgcgcttcgttggcggccagcatcttgcggaagttcttgatgcccgaggctgccagggtacggatcgggccagccgatacgcagttgacgcgggtgccgtccgggcccagggaaccggccaggtaacgtacgccagcttccagcgaagccttggccatgcccatgacgttgtagtttggcatggtgcgttcggcgcccaggtacgacagggtcagcaggctgccgttgcggcctttcatcatttcgcgaccggctttggccagggccacgaagctgtaggcgctgatgtcgtgagcgatgcggaaaccgtcacgggtggtggcttcggtgaagtcgccgtccagttggtcgcccggggcgaaaccaacggagtgaacgatgcagtccaggccatcccacttcttgctcagtgcttcgaagaccttggcgatttcttcatcgctggccacgtcgcacgggaagcacagctcagggctcgaaccccagccttgggcgaattcttcaacacgacctttcagtttgtcgttctgataagtgaaggcaagctcagcgccctcgcgatgcatggcggcagcgatgccggatgcgatggacagcttgctggcgacaccgacgatcagtacgcgcttaccggcgagaaaacccatgtgttgctcctctttcaggttattgcgcagtggctggtgccaaaaaagcggcttccagcaactgctgtgtatacggatgttggggggcggcaaaaatactttgcgcgtctccctgttcgaccacttggccatgcttgaccaccatcaactggtggctcagcgctttgacgacagccaggtcatggctgataaacaaatacgtcaggttgtacttggcttgcagtgaacgcaacagctccaccacttgccgctgcaccgtgcggtcgagcgccgacgtcggctcgtccagcaggatcagcgccggtttcagcaccaaagcccgggcaatggcgattcgttgccgttgcccaccggaaaattcgtgggggtagcggtgccgggtttccggatccagacctacctccttcaatgccgcaataatcgccgcttcctgttcctcggcgctgcccatcttgtgaatccgcaggccttcgccaacgatatcgctgacgcacatgcgcgggctcaggctgccaaacgggtcctgaaacaccacctgcatctcccgacgcaacgggcgaacctcgttctgcgtcaggcagtctagctgcttgccttcaaagcggatcgcgcctttgctgccgatcagccgcaaaatcgccagacccagcgtggatttgccggaaccgctttcccccacaatccccaaggtctgaccctgaggcaggctgaaattgatgccgtccactgccttgacgtgatccaccgtgcgcttgagcaggcctttcttgatcgggaaccagactttcaggtcctcgacttcaagcagcggcgcgccgattttattgctcgccgggcctccgctgggctccgcgccgagcaattcccgagtgtacggatgctgcggcgaacggaacagctcttcgcacgatgcctgttcgacgatgcaaccgcgctgcatgacacatacgcgatgcgcaattcttcgcaccaggttcaaatcgtgactgatcagtaacagcgacatgcccaatctggcctgcaattccttaagcaaatcgaggattttcagctgaacggtcacgtccagagcggtggtcggctcgtcggcaatcagcagttccggctcgttggccagcgccatggcgatcatcacgcgctggcgctgaccgccggacaattcgtggggcagggccttgaggcgcttgtgcggctcggggatgccgaccatctccagcagctccagcgtgcgcttggtcgcgactttgccggtcaggcccttgtggatgccgagcacttcgttgatctgcttctcgatcgaatgcagtgggttcagcgaggtcatcggctcctgaaaaatcattgcgatgcgattgccgcgaatgtgccggatggtcttttcgctcatccccagcagattttgcccggcgtaattgatgctgccggccggatggcgggccatagggtagggcagcaggcgcagaatcgagtgcgcggtcaccgatttgcccgagccggattcgccgaccagtgccagggtttcgccacgcttgatgtcgaaactcacgccttcaacgacccggtgcacgcgctcgccgaaaccgaattcgacggcgaggtcgcgcacttcgatcagattgtcctgattcatttcacttcctcgggtcgaaggcatcgcgagcggactcgccgataaacaccagcaaactcaacatcaacgccaacacggcaaaggcactcatgcccagccacggcgcttgcaggttggatttgccttgggcgaccagttcccccagcgacggactgccggccggcaaaccgaaaccgaggaagtccagcgcggtgagggtgccgatggcgccggtgaggatgaacggcatgaacgtcatggtcgagaccatcgcgttgggcaggatgtggcggaacatgatcgcgccgttctgcatgcccagcgcccgcgcggcgcgcacgtattcgaggttgcggccacggaggaactcggcgcgtaccacgtcgaccaggctcatccacgagaacagcagcatgatccccagcagccaccagaaattcggctgcacaaaactggcgagaatgatcagcaggtacagcactggcagccccgaccagatttccagaaaacgctgcccggccagatcaacccagccgccatagaaaccctgaagggcgccggcaatcacgccgataatcgaactcaacacggtcaacgtcagcgcaaacagcaccgaaatgcggaaaccgtaaatcacccgcgccagcacgtcgcggccctgatcgtcggtaccgagcaggttgtccgccgagggcggggcaggggccgggactttcaggtcgtagttgatgctttggtagttataaggaatcggcgcccacagcacccaggcatccttggccttgagcagttcgcggatgtacgggctcttgtagttggcttccagcggaaattcgccgccgaaggtggtttccgggtagcgcttgatcgccgggaagtaccagttgttgtcgtaatgcaccaccagcggcttgtcgttggcgatcagttcggcaccgaggcttagcccgaacaggatcagaaacagccacagcgaccaccagccacgcttgttggccttgaacagttcgaagcggcggcggttgagaggggacaggttcatctcaatgctcccggctttcgaagtcgatgcgcggatcgaccagggtgtaggtgaggtcgccgatcagtttcaccaccagcccgagcagggtgaagatgaacagggtgccgaacaccaccgggtaatcgcggttgatcgccgcttcgaaactcatcaggccgaggccgtcgagggagaagattacttcgaccagcaaggagccggtgaagaaaatcccgatgaacgccgacgggaatccggcaatcaccagcagcatggcgttgcggaacacgtggccgtagagcacgcggtggcgggtcaggcctttggccttggcggtgaccacgtactgtttgttgatctcgtcgagaaagctgtttttggtcaacagggtcatggtcgcaaagttgccgatcaccagcgccgtcactggcaatgccaggtgccagaagtaatcgaggatcttgccgccgaagctcagctcatcgaagttgttcgaggtcagcccgcgcaacgggaaccagtcgagataactgccgccggcaaacaccacgatcagcagaatcgcaaagaggaacgccgggatcgcatagccgacgatgatcgccgaactggtccagacgtcgaagtggctgccgtgtcgcgtggccttggctatccccagcgggatcgacaccaggtacatgatcagcgtgctccacagccccagcgagatcgataccggcatcttttccttgatcaggtcgatgaccttggcgtcgcggaaaaagctgtcgccgaaatccagcttggcgtagttcttgaccatgatccacagccgttccggggccgacttgtcgaacccgtacatgtgctcgatttccttgatcagcgccgggtccagcccctgcgcgccgcgataggacgaaccggccaccgacacctcggcaccgccgccggcgatgcggctggtggcgccttcgaagccttcgagcttggcgatcatctgttccaccgggccaccgggcgcggcctggatgatcacgaagttgatcagcagaatgccgaacagggtcggaatgatgagcagcagtcgccgaaaaatatacgccagcatctgattactccgtgcccacagggtcggcttgcagtttggtttcgacttctatcgccggttttgcgttcggcttgacccaccaggtgttgatgccgatgtcatacttgggtgagaccttcgggtgaccgatgtgattccagtaagccacgcgccaggtcttgatgtgccagttgggcactacgtagtagccccattgcagcacgcgatccagtgcgcgggcatgggccacgaggcttttgcgcgagtcggcgttgatcaggttctcgaccagttgatcgacgatcggatccttcaggcccatggtgttgcggctgctggccttgtcggcagcggcgctcatccagtattcgcgctgttcgttacccggcgagttggactgcggaaagctgccgaccatcatgtcgaagtctcgcgagcgcacgcggttgatgtactgcgaaacgtcgacgcgacggatcaccagatcaatgccgaggtcgctgaggttgcgcttgaacggcagcaaaacccgctcgaactcggtctgcgcgagtaagaattcaatcactactggcttgcccgtagcgtcgaccatcttgtcgtcgacgatcttccagccggcctcttgcagcagttgataggcctcgcgctgctgggcgcggatcatgccgctggcgtcggtcttggggggctcgaacgcttcgctgaacacctgcgccggtagtttgctgcggaacggctcgaggatcgttcgttgatcagcatcgggcaggccggtggcggccatttccgagttctcgaagtagctgcgagtgcggaagtaggcgccgttgaacagttgtttgttggtccactcgaaatcgaacagcaacccgagcgcctgacgcacccgcacgtcctggaacaccggacggcgcaggttgaagacaaacccctgcatgccggtcgggttgctgttggcaatctgctccttgatcaaccgtccttcagtgacggccggaatgttgtaggcgttggcccagttttttgcggccatctccagccagtaatcgaactggccggccttcaaggcttcaagggcgacggtgttgtcacggtagtaatcggtggtcatcgtgtcgaaattgtagaaaccgcggttgaccggcaggtccttgccccagtaatccttgacccgctcgtagcgcaccgagcgtccggccttcacttcggcgaccttgtacgggccgctgcccagcggaatctccaggttgcccttgttgaaatcacgatcggcccaccagtgttttggcagcaccggcaattggccgaggatcagtggcaactcgcggttgttgctgtgcttgaacttgaacaggactttcagcgggtcttcggcgatcacttcggacacgtcgctgtagtagccgcgaaacatcggcgagccttccttggtcagcgtgttgaagctgaacaccacgtcgtcggcgcgcaccgggtggccgtcatggaagcgtgcttcggggcgcaggtagaagcgcacccagctgttgtccggggccttttcgattttgcctgcgatcaggccgtattcggtgaacggctcgtcaaggctgtgcttggtcagggtgtcgtagatctgcccgatgtcatcggccggcacgcctttgctgatgaacgggttgaggctgtcgaagccgccgaatccggcctgacggaacacgccacccttgggcgcgtcgggattcacataatcgaaatgcttgaaatcggccgggtatttcggcggctcgttgtacagggtcacggcgtgttgcggggcggcaaaggccagcccggcgaacagtaagccgctggcctggacgagcaggtcgcggataggtttcatcgatctttctccgaagacttcagccaccacgcgctcaggcccagggtgtagggcggcgtggtgacgaaggccaaccggttgcggtaggccaaacggtgataattgaggtaccagttgggaatgctgtagtgctgccagagcagcacgcggtcgagcgccttgccggcggcgacctgctcgtcgcgagtgcgtgcggcgagcaattgttcaagcaggtgatcgaccaccggattggcgatgcccgcgtaattcttgctgcccttgactccgacctggctggagtggaagtactgccactgctcaaggcccgggctaagggtctggttgagcgtcatcgagatcatgtcgaaatcaaattgatcaaggcgctgtttgtactgcgcccgatccacggtgcgcaggcgcgcgtcgatgccgatgctgttgaggttctcgatgtagggctggtagaggcgctccaggttcggattgaccagcaatagctcgaagcgcagcggttggccgtcagcgttttgcaggcgctgaccgttgagcttccagccggcttcggcgagcaacgccaatgccttgcgcatggtttcccggggaatgccgcgaccgtcggtttttggcagagtgaacggttcggtgaacagcttggccggcagttgttccttgtacggcttgagcatcagccattcccccccgaccggcaggccggaggttgtgaattcactgttggggtagtaactggtggtgcgcttgtaggcatcgctgaacagtgcgcggttggtccactcgaagtcgaacatcaggcccagcgcttcgcgggtcttcacatcggcgaaggtggcgcggcgggtgttcatgaacagaccctgactctgggtcgggatctgatgcgggatctgcgccttgatcacgtcgccacggcgtatcgcggggaagttgtagccgttggcccagtttttcgcctgatgctcgatgtaaatgtcgaattcgccagccttgaacgcttcgaaggcgacatcgctgtcgcggtagaactcgacttccatgcgatcgaagttgtacttgccgcgattgaccggcaagtccttgccccagtaatccttgacccgttcgaagatcaactgccggcccggcgtgaccgaggtgatgcgatacggcccgctgcccagtggcggttcgaaggtggtggccttgaagtcgcggtctttccagtaatgctgcggcagcaccggcaactcaccgaggcgcaggatcaacagcggattgcccgagcgcttgagcacgaagcgaatgcgctgtttgttgagaatgtcgacgcgcagcacttcctgcagcgcggtgcggtacagcggatgaccgtccttgagcagcgttcgataggagaacgccacgtcataagcggtgatcggcgtgccgtcgtggaagcgcgcctcgggacgcaggttgaagacgacccagctgcgatcttcgctgtattccaccgattgcgcgatcaagccgtaactcgacgcgggttcgtcaccggatggcgaatactggccggtgccgaccatcagcggctcgttcagctcgttgatgccgtactgaaggaaattcgctgtggtgaccgggcttgtgcccttgaacgtgtacggattgaccgtatcgaaggtgccgaacgccatcacccgcaacgtaccgcccttgggcgcttgcgggttgacccagtcgaagtgggtaaatctggccgggtacttgagcgtgccgaactgcgcataaccgtgactttcggtaatcgtcgcgcttgcggttgagctcaaggccaggctgatcaggagcaggaggaggggacgcttcaagtcagatccgatccaggcggcttgggctttgtgggccgtacagtaacagcttgtctgggcaggaaaaagatgcgggttaatgcgcggttaatcgtttgcgcgaagagcccctcaccctaaccctctcccggggggagaggggactgatcgtggtgtctgggcgaattgcaccgacgtgctgcaccgagtcgaactcaagttttcaaaagcccctcaccctaaccctctcccggggggagaggggactgattgcggtgtttgggcgaattgcgccgacgtgtgataccgagccgaactcacgttttgaaaagccccttaccctaaccctctcccggggagagaggggactgactgtggtgtttgcgagagctgcaccgacgtgcgataccgagtcgaactcggatgttgaacagcacggaggtcggctccctttccccctcgcccccttgggggcggtccgacgtttcgggagggctggggtgagggggatggatctaaagcacaccacaaaaacgtgatcaaaaaaaagcccctgcaaactcaggggctcttcgatcagtgcggctgataaaccgtgagcatctgccccggcttcaacgctttacccgcacccggattccagcgcttgagatgctgcatctcaacgttgaaacgcttggccaccacgtacagcgtgtcgccgcgcttgaccttgtactgggtctgctgcgcgctgtcgtccttgcctttgttcttgctgttggccgcaatcactgtgttgacgcgcccagatttgcgagccggcgcacgcttgctggtgtcctgcatcaccagggtctggccgaccttgaggttcttgccggtcagcttgttccagcgctgcagatccttgacttcaaccttgttggccttggcgatggagccgaggttgtcgccacgcttcacgcggtaagcacgcttgagttttgccacctcggaaggatcggcaccctcgaacaccggcttcagcgagcgcgggctgatcagctcgtcaggccgcatggtctgcaggctggcggtcagcagttgcgccttcgacgttggcaccagcaaatgctgagggccgtcgatggtggtgcgctgcttgaacgccgggttgagctggaacagttcgtcttcgtcgatgttcgccaccgcggcaaccttggacaggtccatgcgctggttgatttcgacgacctggaagtacggttcgttggcgatcgggttgaggttgaccccgtaggcctctggcgccagcaccacttgcgacaatgccagcagcttcggcacgtacgcctgggtttccgccggcagtggcaggttccagtagtcggtcggcaggccaagcttttcgttacgttcgatcgcgcggctgaccgtgccttcgccggcgttgtacgcggccagggcgagcaaccagtcgccgttgaacatgtcgtgcaggcgagtcaggtaatccatcgctgccgtagtcgaggcagtgatgtcgcgacggccatcatagaaacgggtctggcgcaggttgaagtaacgcccggtggacggaatgaattgccacagcccgacagcatcggcgcgcgaataggccatcgggttgtaggcgctttcaatcactggcagcagggccagttccagcggcatgttgcgttcttcgaggcgttcgacgatgtagtgaatatagagactgccgcgttcgccggcgttctcgaggaaagagggattgctggcgaaccacaggcgctgttgctcgatgcgcggatttacgccgaggccttcctgcaactggaagccctggcgcatgcgttcccagatatcctggggaacctgtgggctgggcttttcggtcagccagatcggcttctgcttggctcgcgcagcaatgttcggcgtatgggtcgcttcagtctgcggagcatggctggaacagcccgccagcgtggcggacacagccaccgcgatggcttgcgccaggcgggtcaatgcgtctgaattgacggacttacgtatggatgacgacattggctggaagtaagttccgggcaaaaatgtcgggcgattctagaaagcgcaccccttgcggtcaaccattcagaatttttgtaccaggcaagagggtgcttagaacttatctttccatgcccgcagagccgcaaatacctcactcggcgcccggttttgagcgcctgcccgttcgtccactttttgtgtaactaatgtttcactggtgcgcaaaaacggatttgtgagcttttccagggccagggtcgaaggcagggtcatgacgccgttctgccgttgtcgggtgactttttccagacgggcggcaatgtccgggttcgtcggctcgacggcggcggcgaacttgaggttgctcagggtgtattcatgggtgcagtagaccagcgtatcttccggtaacgcggcgagacggctgagcgagtggtgcatctgttccggcgtgccttcgaacagtcgcccgcaaccggcggcgaacagggtgtcgccgcagaacagcagaccgtgatggtagtaggcgatgtgtcccaaagtgtgaccgggcaccgcatagacagcgaagtcccagccaagcacgctgacggtatcgttgtccttgagcgcgacgtcgcgccccggaatgctttcgctggccgggccgtaaacagtcgcgccgctcgcggctttcaggcgttcgacgccgccgacgtgatcatggtgatggtgggtaatcaggatgtcgctcaagacccaacccggatgggcctcgatccatgccatcacgggcgcggcatcgcccggatcgaccaccgcgcagcgttgggtgcggtgatcctgtaacaaccagatgtagttgtcggtgaacgcgggcagggcactgatctgtatcatcgtcggaattcgccaagcggaaaacattggcgcatcttagtagttcctggcgctttggagaatgcgatgagtgataaagcgttcgcacaggctgatcctgactggctggccctgatcggcgcagcccgtgaatggctgtccggcccgctcgggcaatttctgctcgatgaagagcggcgcatgctcgaagacgagttgggccggttcttcggcggttatctggtgcattacgggccatcggccgaaaccccgccgtcggcgccgcaggtgcagcgcaatgtgcgtcttggcgcgccgttgccgggcgtcgagattgtctgcgaagagcaagcctggccgctgagcgagcacgccgctgacgtggtagtgatgcagcacggtctggatttctgcctgtcgccccacggtttgctgcgtgaagcggcaagcagtgtgcgccccggcgggcacttgctgatcatcggcatcaatccgtggagcacgtggggtttacgccatgttttcgcccatgacgccttgcgccaggcgcgctgcatctcgccgtcgcgggttgccgactggctcaatctgctgggcttcgcgctggagaaacgccgcttcgggtgctatcgtccgccgctcgcgtcacccaagtggcaggcccgcttggccggctgggaacgcaaggccggtgactggcaactgtcgggcggcggcttctatttattggtggcgcgcaagattgttgtcgggctgcggccattgcgtcaggagcgccgcgagccgatgggcaagctgattccgctgcctatggccaaggtcaatcgccgccgcattgaaccgtaaaccttcttttatttgtggccgggcatgtcccggcccgggccatcgtcgatccgtgatcggcgaggcaggcatttattctggatagagtggcatgagcgaaagcgttgaaagcgtcgacaccgtagaactgttcaccgacggtgcctgcaagggcaatcctggcccgggcggctggggcgccttgctggtgtgcaaaggcgttgaaaaggaactgtggggcggcgaggccaacaccaccaacaaccgcatggaattgctcggcgccattcgcggcctggaagccttgaagcggccgtgcgaagtattgctggtgaccgactcgcaatacgtgatgaagggcatcaacgagtggatggccaactggaagaagcgcggctggaaaaccgctgcgaaagagccggtgaaaaacgctgatctgtggaaagagctggatgagcaggtcaaccgccacaaggtcacctggaaatgggtgcgtgggcacattggtcatcacggtaacgagcgggcggaccagttggccaaccgtggggtggatgaagtgcgcggttacaaacagacctgattccctccgttgcaccgtggtgcccccaatcgcgagcaggctcactcctacaattggaatgcatttccctgtaggagtgagcctgctcgcgatgaatgatgacgcgctaactcagaaatacgcgtgttaacatccgcgttttttgcaagatcgacccgttgagagctgaacactgatggccaccagatccgttgtactcgataccgaaaccaccggcatgccggtgaccgatggtcaccggatcattgaaatcggctgtgtcgaactgatcggtcggcgcctgacgggccggcattttcacgtctacctgcaaccggatcgcgaaagtgacgaaggcgccatcggtgttcacggcatcaccaacgaattcctcgtcggcaagccgcgtttcaacgaagtcgccgatgagttcttcgaattcatcaagggcgcgcagctgatcatccacaacgcggcgttcgacgttggtttcatcaacaacgaattcgccttgatggggcagaaggatcgcgctgacatcacgcagcactgctcgatcctcgacaccctgatgatggcccgggaacgtcacccggggcagcgcaacagcctcgatgcattgtgcaaacgctatggcgtcgacaactccggccgtgaactgcacggcgccttgctcgactcggagattctcgccgacgtctacctgaccatgaccggtggccagaccagcctgtcgctggcgggcaatgcatcggacggtaatggctcgggcgagggtgcggacaactcggcgaccgagattcgtcgtttgccggcagatcgtcagcctgcgcgaatcattcgtgcgactgaagatgagttggcggcgcatctggtgcggttggagattattgccaagtctgccggtggcccggcgttatggacgcagatcgccgaagccgacgcccaagcctgaagatcaaaagatcgtccgatcgcggcccgaacctgcggcagctcctatattggaatgcaatcccctgtaggagctgtcacaggctgcgatcttttgcttatggcgccatgaagccaactggccaccctcgccacattcgctgcaaccctctaccctgagtgcattggcagctgcaaacctgccgcctcaggatactgagccccatgtacaaagatttgaagttcccggtgttgatcgtccatcgcgatatcaaggccgacacggtcgccggtgaccgtatccgtggcatcgcccgggagttggagcaggaaggtttcagtatcgtttcggctaccgactacgccgaaggtcggttggtggcgtcgacccatcatggcctcgcgtgcatgctgattgctgccgaggacgccagcactaattcccatctgttgcagaacatggccgaactgatcggcctggcgcgggtgcgtgcgccggaactgccgatctttgccttgggtgaacaagtcacgttggaaaacgcccctgccgacgcgatggccgagctcaaccaactgcgcggcattctctatctgttcgaagacaccgtggcgtttctcgccaggcaagtcgcgcgggcggcgcgcaagtatctggatggtttactgccaccgtttttcaaggccctggtgcagcacacggcggactccaattattcctggcacacccccggtcatggcggcggtgtggcttatcacaagagtccggtggggcaggcatttcaccagttctttggcgaaaacaccctgcgttcggatttgtcggtgtcggtgccggagctgggttcgctgctcgatcacaccgggccgctcgccgaagccgaggcgcgcgcggcgcgcaatttcggcgctgaccacacctttttcgtgatcaatggcacctcgaccgccaacaagatcgtctggcactcgatggtcgcgcgcgatgacttggtgctggtcgaccgcaattgccacaagtcggtgttgcacgcgatcatcatgaccggcgcaatcccgctctacctgtgcccggagcgcaatgagctgggaatcatcgggccgatcccgttgagtgaattcagtcgcgaatcgatccaggcgaagatcgacgccagtccgctgacaaagggccgtgcgccgaaagtcaaactcgcggtggtgaccaattcaacctacgacggcctctgttacaacgccgagctgatcaagcaaagtctcggcaatagcgttgaagtgctgcatttcgacgaggcctggtatgcctacgcggcgtttcacgagttcttcgccggacgctatggcatggccacctcacgcggcgaagacagcccgctggtgttcaccacccattcgacacacaaattgctcgcggcattcagtcaggcctcgatgattcatgtgcaggacggcggtgcgcggcaactggatcgcgatcggttcaatgaagcgttcatgatgcatatctcgacgtcgccgcagtacagcatcatcgcttcgctggatgtggcgtcggcgatgatggaaggcccggccgggcgctcactgttgcaggaaacctttgatgaagcgctgagcttccgccgtgcgttggccaatctgcgccagcatatcgctgccgatgactggtggttttcgatctggcagccgccgggcgtcgaaggcattgaccgcgtaaagacagaggactggctactgcaaccggatgccgactggcatggttttggtgaagtcagtgacgattacgtcttgctcgatccgatcaaggtcacgctggtaatgccggggttgaatgccggcggtgcgttgagcgagaagggcattccggcggcggtggtcagcaagttcctctgggagcgcgggctggtggtcgagaagaccgggctgtactcctttctggtgctgttctcgatgggcattaccaagggtaaatggagcacgttgctgactgaattactggaattcaagcgcagctacgacgccaacgtgcgtctggaaagctgtctgccctgcgtcgcccaagaagatgccgggcgctatcgcggcatggggttgcgcgatttgtgcgatcaactgcatgcctgttaccgcagcaatgccacggccaaacacctcaaacgcatgtacaccgtgctccccgagatcgccatgaaacccgcacatgcttacgatcatctggtgcgcggcgaagtcgaggcggtgccgatcgatgcgctggaagggcggatcgctgcggtgatgctggtgccgtatccgccggggattccgttgatcatgcccggcgagcgcttcaccgaggcgacccgttcgatcatcgattacctgaaatttgcccgcacgttcgatagcagctttcccggttttgtcgctgatgtgcatggactgcaacacgaagacgaaggcaatgggcggcattacaccgtcgattgcgtcaaggaatgaggacttttccgagtatgcaaccggtcatgaatccaaaatacccagggctgtcggtgcgtgtcgccgacgaaggttttgcgccttatatctggggcagcgacttcagcttcgaggtcgcagcctacggcgcagcggtgatcggcaaagcggtcgagcagtggccggtgacgccgatcgtgccttatcgcaagtgctacggcatcgaccccgaggagttcagcagttaccgtgatgcgcctgacagcgcgattttcatggcctatctggacgatgaaccggtcggtcatctggtgatcagtaccaactggaatggctttgcgcatatcgatgagctggcggtgcacgcgccggcgcggcggcatggcgtggccaaggcgttgctggatgtcgcgcagttctggagtcgcaagaaaaagctgccggggatcatgctcgaaacccagaacaacaacctcggtgcctgtcgattgtacgagcgctgcggttatgtgattggtggtattgaccagttgcgctatcgcggtattgatccgaacaccgccgaagtagcgctgttctggtatcgattgttcgataatccgctggagagttccgtcagctcgccagcatcgcctcggcttgttccgtgacgatggtgagcagcgtctgaatcgccgctgacggcgcggcgtgcttgaaggtcagggcgtacaggctgatcggcacggccggcgacagcgggcagacatccagcccggcggcgcgcgcgcccagtgcggtaaacggatcgacgatggccaggccttcgccagcctcgacgatgctgcgcatcatctgatgggtttgcacgcgggtctggatgctcggtgcggggcgcagggcctggagcttgttttccagcgccgggctcagtgggtcctggccttcgaggccgaccatggcctgaccggccagatcctgcagggaaatgtatttctgtttcggttgtagccagccatgaggcgcgagcaattgcaacttgccctgggccagtggctggcaatcaatgtcgggatgttcggggtcgtgcaggcttagaccgagatcactttcgcgcagcaacaggttacggacgatgtcgcgggtcggtgcactgagcaggctgcacggcgcatccggcagacgtcggcgcagggcggcgaggctttgtggcagtaattgttgcgccagcggtggggtgccgatgatgcgcaggggcggggcgaggtattgcttgagactgctggccaaacgctgcactggctccagcgcgtcgtagacgtgggcgatttcgacctgcaatgcccgcgcttcgggcgtcgattgcaggcgcccgcgcacgctggcgaacagcatgaaccccaactgactctcggcttcgcgcaaacgctcttcgacctcggccaccggcaactgcagccattcggcggcggtgcccaggtgaccggtctgcaagagcgcctggatcacttcgatatgacgtaaacgcatgcgtgaagtccatgttcagcaggtggggtcagtggctgaatcctaccccaagtctgcgcatatgacttctgctcataacgatgagttatgaagcgacggttggctcaggctcacggatcagggtgatccctgactgaaccaggagaaactcgttctcgttgaccttgttgacgcgatcgccaatggccagtttgtaaataggctccgaaccagtggaaccgtctaccgacgggttggattcctggaactcatgcacggaataaacgcggccttccgcatctcttgcatggaactgaccgacgagtactgctgccatctgcttagaacctctggagataaaacgcttgatttgcggcttggtagaccgccatcaaggcctgtaagttttcctacaggaaaaaaataatcaacacgcgggaatttccctcgggtgctggtggaatcgtcaccgaatcatctataactactcgctcctcccacggacaatcgagagtcttccatgagcaatgtctacaacgtcgcggtagtggtcggtagcctgcgcaaagcatcgatcaatcgcaaggtcgccctggcgctggcggagctggccccggcgaacctcaagcttgagattgtcgagataggcgatctgccactttataacgaagacatcgacggtgattcaccgccggcagcctacagtactttccgggaaaaagtgggttcatccgacgcggtgctgtttgtcacgcccgagtacaaccgttcagtaccggcgccgttgaagaatgccatcgacgttggctcgcggccttatggcaaggctgtctggagtggcaagccgggggcggtgatcagtgtctcgcccggtgccattggtggtttcggcgccaaccagcatttgcgccagtcgttcgtgtttctcaatgtgccgtgcatgcagcagccggaggcttatctgggcggcgcgggctcggcgtttgacgaggcgggcaagttgagcgaaacggtgaaaccttttctgcagagttttatcaatgcgtacggacaattcgtagagcaacacaagaagtaacttcaccgaatcccctgtgggagcgagcctgctcgcgaaggcgtcgtcagccgttgcatcaatggcgactgacagtgcgctttcgcgagcaggctcgctcccacaggttatctttctggctcggcactcgtcgtggcctttttacctcactctttgaaggctgttgcggatgctcgctgcgtcactgattttcctgctgaccatcacccttgtcatctggcaacccaaaggcctcggcgtcggctggagtgcgacgcttggcgcaatcctggcgctgattttcggcgtcgttcatctcagcgacattccgttggtgtggcagatcatctggaacgccaccggcacctttgtcgcgctgatcattatcagcctgctgctcgacgaagccgggttctttaattgggccgcgctgcacgtggcgcgttgggggcggggcagcggacgcaagttgtttgcttttatggtgctgcttggcgcactggtgtcggcgttgtttgccaacgacggcgcggcgctgattctcacgccgatcgtgatttcgatgctgctggcgctacgcttttccccggccgcgaccctggcattcgtgatgggtgcaggatttatcgccgacaccgcgagcctgccactggtagtgtcgaacctggtcaacatcgtttcggcggacttctttcacatcggcttcaaccgttatgcggcggtaatggtgccggtcaacttcgtcagcgtggcggcgacgctgggcatgttgctgtggttcttccgtcgcgacattcccaaggcctacgacccggagcagcttgagcacccagaaaccgcgatccacgacaaagccacgttctatgccggttgggcggtgttggcgattctgttgatcggctgttttgcccttgagccgctgggcattccgatcagcgcgatttccgccgtgtgcgccgcgctgctgttgggtatcgccgcgcgcggccacaagatttccacgcgcaaggtgatgaaagaagcgccgtggcagatcgtgattttctcgttgggcatgtatctggtggtctacggtctgcgtaatgccgggttgaccgggtatctggccggttggctggatgtcttcgcaggtcacggcgtgtggggcgcggccatgggcaccggtgtgctgacggcgttgctgtcgtcgatcatgaataacctgccgacggtgttgattggcttgttgtcgattgacgccagtcaggcgagcggggtggtcaaggaggcgatgatctatgccaacgtgattggcagcgatctggggccgaagattaccccgattggcagtctggccacgttgttgtggctgcatgtgctggagcgcaagggcattcacattggttgggggtattacttccgggtcgggattgtgttgacggtgccggtgttgttggtgacgttggcggctttggctgtgcggctgtccctgtagaccgaggtgaccccatcgcgagcaggctcactcctacaggggaacgcattccaatgtaggagtgagcctgctcgcgatggggccggtacaggcgacaaaaaactcaggcctggccgggtacattcggccaaagatccgataccagaaacaaccgctccgcctcttcccattcccctcgtgcattctcggtcaggcgcaccagcaactgcgccggggccagcggttcaagatcttccagccagatccgtaaatgctcgagagtccaggtctgatccgccggataatgcgccggcgccagccaggcatgccggggcaggggttgccagcgtccggccgggcgttgtgcgacaaacgctggccaatccttctgatgcaaccagctaccgcgcaaatgctgcggatgtgcgccgctcggtgattcggactgccctggccacgggtaaagcaaatagccgcccagccacagttgcgcgctgaacacctcgatatccagcgccgccagcacctcacggctttccggacgcgccgagatcggcagttgatgctcggccagatgcgccagtttacggtccagtcgatcatgacagcccggccccagccactgtgccgtatcacggccatcgccgctctgtgggccgaggtagagcttgatcgccaattccaggtgatgcacgccatcgcggtcacgcagaagcatgtccagctcgccaagtgtgtggccctcgcggcggatcggcaggttggcggcaatcagctcaatgccgggcgcatgctccacggcaaactgccaaagccgctcgtaatacaggcccagacgtcgcgtgcgtgcctgcgacaaccaatgcagcaagccataactgtcacggtcgagctgacgcaaccagtgctccagacgttcagggtcggccacccaatcgctgccggccagcggatgacgctgcggccacggcgtggtggcgagcattggcggggcgaggatcacccacgccagatcgcgcacttccgggtggcgtaattggtgaggcaactgcagcaaatctggaaataggatcatcttgcgagcatagccgtaaacacgagcgcacccttgaggctgaaaggattttgtctaaccggcgctttcgcccataatcgggtttttcgcgttttcgattgtccgcagaggtcccatggagcaatttcgtaatatcggcatcatcggtcgcctgggcagttcccaggtgctggataccgtccgccgactgaaacgctttctgctcgatcgtcacctgcatgtgatcctcgaagacaccatcgccgaagtcctgccgggccacggcttgcaaacctcgtcgcgcaagatgctcggcgaagtctgcgacatggtcatcgtcgtcggcggtgacggcagtctgctcggcgctgcgcgggcgctggccaaacacaatattccggtactggggatcaaccgtggcagcctcggttttctgacagacattcgcccggatgagctggaagtcgaagtcgccaaggtgctcgacggtcactacctggtggaaaaccgcttcctgctgcaagccgaagtgcgccggcatgccgaggccatcggtcagggcgatgcgctcaatgacgtggtgctgcacccgggcaaatcgacgcggatgatcgagttcgagctgtacatcgacggccagttcgtctgcagccagaaggccgacggcctgatcgtcgcgacaccgaccggttctaccgcgtacgcgctgtctgccggcgggccgatcatgcatcccaagctcgatgccattgtgatcgtgccgatgtacccccatatgttgtcgagccggccaattgtggtcgatggcaacagtgagctgaaaatcgtcgtgtcgaaaaacatgcagatttacccgcaagtctcctgcgacgggcagaaccacttcacctgcgcgccgggcgacaccatcaccgtcagcaagaaagcgcagaagctgcggctgattcacccgctcgaccacaactactacgaagtctgccgcaccaagctcggctggggcagcaagctgggtggtggaggcgactgatgctcgatcccgcgcgcagttatgacctgatcggtgacgtgcacggatgcgccctgaccctcgaacacttgcttgaccgactcggttaccacaagcagggcggggtctggcggcatccatcgcgcatggccgtgttcgtcggcgacatcatcgaccgtggcccgcgcattcgcgaggcgctgcacattgtccatgacatggtcgaggccggtcaggccttgtgcatcatgggcaaccacgaattcaacgcgctgggctggagcaccccggcgccaccgggcagcggcaagcagttcgtgcgcgaacacacgccgcgccacgcgcgcctgctgcatgaaaccctgacccagttcgaagaccatcctggcgactggcatgattttcagcgctggttctatgagctgccgctgtttgttgacgccggacgcttccgtgttgtgcatgcctgttgggatgccggtctgatcgagccgttgcgcgcgcaattcgcgaatggctgcattgacgaacactttcttcaggcgtccgccgtgcccggcagtttcgcctgcaccgtgttcgatcgtctgttacgcggcaccgacatgcgcctgccggatggtctgaccatgaccagcggcgatggcctggtgcgttcgttcttccgcaccaagttctgggaagacgacccgaaaacctacggcgacattgtcttccagcctgatgctctgccagaaccggtggcgcagaaaccgctgacctccagcgaaaaaaacaccctgctgcgctacggcgtcgacgagccattgctgttcgtcggccactattggcgcagcggcaaaccggcgccgatccgcccgaaccttgcgtgtctggattacagcgcggtgctctacggcaaactggtcgcctatcgtctggatcaggaaacacgtctggatccgcataaatttgtctgggtcgatgtcgagcggccggaggtgctgcaatgagtgcggtagcggtattgcgtctgccattggcggtggacttgagcggtttcgtcaaactgctgcaacgcatgcaggtcccgcatcgggtcagcgaagaggcgggcgaacaggtgttgtgggcgccgtcggagatcagcgaagacgtgcgctcgctgtacgaacgcttcccggccggcgatcctgatcagcaactggatatccctgttgcgcagaccgtcaagcgcccaagcttcgctgagcaattgaagtacgccaaagccaccggtttcattctgctgttgtgcctggttgtcggtggcttgacctacctcggcgaaaacctgcagacgttgcgctggctgaccttcctcgattttcaggtggtcggtgaatacatccatttcgtgccgttggccgacagtctggcggcggggcagtggtggcgactggtcacgccgatgctgatccacttcggcatcctgcacctggccatgaacggcatgtggtattgggagctgggccggcgtatcgagtcgcgtcagggcagcatcaacctgatcggcctgacactgctgttcagtctggtgtccaactacgcgcagtttgtctggagcggcgcgaccttgtttggcggcctgtcgggcgtgctgtacggtttgctcggacattgctggatcttccagctgctgtcgccgaacccggcctatcgcctgccgcgcggcgtgctggtgatgatgctggtgtggttgctggtgtgcatgtccgggctgatctcgatgatcggcttcggcgaaatcgccaacgccgcccatgtcggcgggttactcatcggatgcttcaccggtttgttgggcggtttgtataaccgccgtaaactggccgcctaaattttcagcagataaagagcacggagaccctgatgtcctcttttaacgacatgatcaacaacatcaccccggacatctacgagagcctgaaactggccgtggaaatcggcaagtggtccgacggtggcaagctcaccgccgaacagcgcgagctgtcgctgcaggcaatgatcgcctgggaaatccagaatctgcctgaagaccagcgcaccggttacatgggcccgcaggaatgtgcatcgaagtcgatcgaagtgccgaacatcctgttcaagtcggatgccatccattgatcgagattggccgcggtgcaatcagcaaaatgtcggcgcgccttgacgggccgaacgtgcaatacgcgtttcgtctggatgacgtcgaggtgccggtcaacccgttgatcggcaccacggtgcgtctggaatacctgggggcgatccactgcacccattgcgggcgcaagaccaaaaccagtttcagtcagggctattgctacccgtgcatgaccaagctggcgcagtgcgacctgtgcatcatgagcccggagcgttgccactatgacgccggcacctgccgcgatccggcgtggggcgagcagttctgcatgaccgatcacgtggtttacctgtccaattcgtcgggcatcaaggttggcatcacccgtgcaacgcaactgccgacccgctggatcgatcagggcgcgtgtcaggccttgccgatcatgcgcgtttcgacgcggcagcagtcgggcttcgttgaagatttgttccgcagccaagtggccgacaaaaccaactggcgtgcattgctcaagggcgatgcggcggcggtggatctggcgcaggtgcgtgaccagttatttgaaagctgcgccgaaggcctgcaaggtttgcaggagcgattcggcctacaagccattcagacgattgccgatgtagaacctctcgaaatccgctatccggtcgagcaatacccggccaaaatcgtcagcttcaacctggacaagaacccgattgccgaaggcaccctgttagggatcaagggccagtacctgatcttcgataccggcgtgatcaacattcgcaagtacacggcttatcagctcgccgtgcatcaataaggacttcagcatgcgcaccgaacaaccgaagatgatttatctgaaggactatcaggcgcccgagtacctgatcgacgaaacacacctgactttcgagttgttcgaggatcacagcctggtgcacgcgcagttggtgatgcgccgcaacccggcccgtggcccgggcctgccgccgctggtgctcgatggccagcagctggaattgctctcggtgaccctggccgataaagagcttggcgctgctgactatcaattgtccgagaatcatctgaccctgcagccgaccacggaaacgttcacggtcgacaccagcgtcaagatccacccggaaaccaacaccgcactggaaggcctgtacaagtccggcacgatgttctgcacccagtgcgaagcggaaggtttccgcaagatcacctattacctcgaccgcccggacgtgatgagcaagttcaccaccaccgtggtcgccgagcagcacagctatccggtgctgctctccaacggcaacccgatcgcctcgggcccgggcgaagacggccggcactgggcaacctgggaagatccgttcatgaaaccggcgtacctgttcgcgctggtggccggtgatttgtggtgcgttgaagacagcttcaccaccatgaccgaccgcaacgtcgcattgcgcatctacgtcgagccggaaaacatcgacaagtgccagcacgcgatgaccagcctgaagaagtcgatgcgctgggacgaagaggtttacggtcgcgagtacgatctggacatcttcatgatcgtcgccgtcaacgatttcaacatgggcgcgatggagaacaaaggcctcaacatcttcaactccagcgccgtactggcccgcgccgaaaccgcgaccgacgccgcgcaccagcgcgttgaagcgatcgtcgcgcacgaatacttccacaactggtcgggcaaccgcgtgacctgccgcgactggttccagctgtcgctgaaggaaggcttcaccgtattccgcgattccggtttctccgccgacatgaactcggccacggtcaagcgcattcaggacgtcgcctatctgcgtacccatcagtttgctgaagatgcaggtcccatggcccacgccgtgcgtccggacagcttcatcgagatttccaacttctataccctgaccgtgtacgaaaagggttcggaagtggttggcatgatccataccttgctcggcgccgaaggcttccgcaagggcagcgatctgtacttcgatcgccacgacggtcaagcggtcacctgcgacgatttcatcaaagcgatggaagatgccaacggcgtcgacctgacccaattcaagcgctggtacagccaggccggtacaccgcgtctggcagtgagcgagtcttatgacgccgccgcgaaaacctacagcctgaccttccgccagagctgcccggaaaccccggacaaagttgaaaaactgccgttcgtgattccagtcgaactcggcctgctcgacagcaaaggcaacgagattgccctgcgtctgagcggcgaagcagtggcgcaaggcaccacccgcgtgatctcggtgaccgaagccgagcagacgtttaccttcgttgacatcgccgaacagccgctgccatcgctgctgcgcggcttctcggcgccggtgaagctgagcttcccgtacaaccgcgatcaattgatgttcctgatgcagcacgacagcgacggcttcaaccgctgggatgccggtcagcaactgtcggtgcaggtcctgcaagagttgatcggccagcagcagaagggcgagagcctgaaactcgatccgcgtctggtctcggcgctgcgtacggtgctgtcggacgaatcgctggatcaggcgatggtcgctgaaatgctttcgctgccaggtgaggcgtacctcactgaaatcagcgaagtggctgacgtcgatgcgatccatatcgcccgtgagttcgcacgcaagcaattggccgaagggttgttcgaggcgctgtggctgcgttatcaggccaaccgcgacctgtcgaagaaaaccccgtatgtggccgaggccgagcactttgctcgtcgcgcgctgcagaacattgcgctgtcttatctgatgctcagtggtaagccggaagtactggcggcggcgctggagcagttcgaagcggccgacaacatgaccgagcgcctgactgcgctggcggtactggtcaactcaccgttcgaagagcagaaggcgttggcgctggccagtttcgccgagcacttcaaggacaacccgctggtcatggatcagtggttcagcgtgcaggccggcagcactctgccaggcggtctggagcgcgtgaaagcgttgatgcagcacccagcgttcaacatcaagaacccgaacaaggtgcgtgcgctggtcggcgcgttcgccgggcagaacctgatcaacttccatgcggcggatggttcgggttatcgcttcctcgcggatctggtgattgagttgaacgggttcaacccgcaaatcgcttctcgccaattggcaccgctgacgcgctggcgcaaatatgacgatgcgcgtcaggcgttgatgaaaggcgagctggagcggattcgggcgtcggggcagttgtcgagtgatgtgtatgaggttgtgagcaagagcctggcttgatgggcccctcaccctaaccctctcccagtgggagaggggactgaccgaggtgtctttgcgctgtacgccgacctgaaagtccggagtcgaactcaggttttgaacggcccccgatctgctccctttccccctcgcccccttgggggagagggctggggtgagggggtaggatttatgcatcaacacaactccctaagccgtacgcataaaaaacgccgcattaataatgcggcgttttcatttccagaaaaattacttcagatcaaaccgatccagattcgtcaccttcgtccaggcagcgacgaagtccttaacaaactgctccttcgcatccgaactggcgtacacctcggccaaggcccgcaactgcgcattggaaccaaacaccagatcaacccttgtcgccgtccatttcacgttcccgcttttgcggtcacgcccttcaaactcatccgcatcccgtgaagtcggcttccactccacccccatgtccagcaggttggtgaagaagtcattggtcagcgcttcagtctggctggtgaaaacaccatgacgggattgcccgacgttggtgttcaacacccgcaagccaccgagcaacacagtcatttccggcgcagtgagggtgagcagttgcgccttgtcgatcagcagcgcttcagcagaaacggtgtacttggccttgctgtaattacggaagccatcggcaatcggttcgaggaaagcgaaggactcgacatcggtttgctcctgagaagcatcagtgcggccaggtgtgaaagggacagacaccgaatgaccggcgtttttcgccgcttgttcgatgccggcgttcccggccagcacgatcaggtcggccagcgagactttcttgccggcggcaccaccgttgaactggttttgaatcccttcaagcgtactcagcaccttgtccaactgctcaggctggttggcctgccagaacttctgcggtgccaggcgcagacgtccaccgttggcgccaccgcgtttgtccgaaccacggaacgtcgacagtgccgcccaagccgtcgagaccagttgcgaaacggataggcccgaatcaaggattttgcttttcagtgccgcggcgtcgctgtcgtcgatcagcgggtgagtgacgtctggaatcggatcctgccaaagcagttcttcgctcggcagttccgggccgaggtagcgggacagtgggcccatgtcgcggtggatcagtttgtaccaggcgcgggcgaaggcgtcggccagttgctcagggttggcgaggaaacggcgggagatctgctcatatgccgggtcgaaacgcagcgccaggtcggaggtgagcatggtcggcgaaagctttttgctgggatcatgggcatgcggaacggtgccggcaccgccgccatttttcggaatccactggtgggcgccagccgggcttttggtcagttcccattcaaaaccgaacaggttttccaggtagttgttgctccactttgttggcgtggtcgtccaggtcacttccagaccgctggtaatggtgtcggcgcccttgccggtgccgaacgcattgcgccagcccagaccttgttcttcgaggccggccgcttccggctcaggcccgacgttgtcggcagggccggcgccgtgggttttaccgaaggcgtgaccgccagcgatcagtgccacggtttcttcatcgttcatggccatgcggccaaaggtttcgcggatgtcgtgggccgaggccaccgggtccggattaccttcaggaccttcagggttaacgtagatcaggcccatttgcacggcggcgagggggttttccagattgcgttcgccctgatcggtgcggctttcctcttttccgtgcaagtccggctcggccaccagtgtgccgtcaccgggctcctgcatcggcgccttgtccttgccatagcgactgtcgccgccgagccattcgtgttccgaaccccagtaaacgtcctcgtccggctcccacacatcggggcgaccaccggagaagccgaaggtcttgaagcccatggattccagcgcgacgttaccggtgaggacaatcagatccgcccaggaaatgttacggccatatttctgcttgatcggccacagcagacggcgggccttgtcgaggctgacgttatccggccagctgttcagcggcgcaaagcgttgctgaccggagccggcgccaccacggccatcggcggtgcgataggtgccggcgctgtgccaggccatgcgcacgaagagagggccgtagtgcccgaagtcggccggccaccagtcctgagagtcggtcatcaatgcagtgaggtcttgtttcagcgcctggaaatccaggctcttgaaggctttggcgtagtcgaaatccttgcccagcgggtcggacttgggcgagtgctggctgaggattttcaggttgagttgattcggccaccagtcacggttcgtcgtaccaccaccggcggcgtggttgaacgggcatttcgattcgtttgccatgttcgggtccttatcaggtctgctacggccggctcgtgccgacttcggactagtaaggctagacccgacttggagagtcagctaataggccgactattggagggttataggcaaagtctttcagcgtttttcggagcacttcacggatcagccgatagcgactgcctgcttgaaacatgcgttgttgagcctctgcaaaaaacaaaaagtgaaaatcgggatgacaggaagaaatgttattgtataacataaaattcgtttcattctgtttctaccagcgttaaagcaaaacgctggcagcgatcctcactattcagcgcatggaaattttgcaatgcctgcccgttcccaccccctgcaacgacgcctcaatccgttggctgcggcgctgctttttgcaacgccggtgttcgccgccgacaccctcgagctgcaaccgcaagtcatcaccggcaatccgctcggcagccagacactcgcttcgccatcgacggtgctcagcggcgacgacctcacgtttcaacagaagggcagcctcggtgaaaccctgaacaagcaacccggcgtgtcctcgtcgtacttcggtccgggtgcgagccggccgatcatccgcggtcaggacggtgaccgcatccgcatcctgcgcaacggcgtcggcgcgctggatgcttcgtcgctgtcttacgatcacgcggtgccgctggacccggtcaacatcgagcgtgttgaaatcatccggggcccagcggccctgctatacggcggcagcgccattggcggagtggtcaacacttttgataaccgcattccgaccgaggctatcgacggaatccatggcgccggtgagttgcgctacggcggtgccgacaccacgcgaagcagcgccggcaaactcgaggccggtaacggtcagttcgccttgcacctggacgccagtgcccgcgagttcaatgatctgaaaatccccggttacgcgaaaaccgctggcgaacgcgcaaacgacgacggcgactcgaaaaagcatcgactggccaacagcgatggtcgccaggacggcggcgcggtgggcgggtcttacacttgggatgacggatacgccggcctgtcctacagcaactacgactccaattacggttcgcccgctgaacaagacgtgcgcatccgcatgcaacaggagcactacgccttcgcctcggagatacgcaatctcgatgggccattcagctcgatcaaactggatgccggttacaccgattacgagcatcgcgaaatcgaaggcggcgaggtcggtacgacgttcaagaacaaaggttacgaggcgcgtgtcgaagcgcggcatcagccattggggccgttcaacggtgtgattggtacgcaggtcagccgcaacgagttctcggcactcggcgaagaagcgttcgtgccgcagaccgataccgatgccgctgcgctgttcattcttgaagagttgcaagccaccgaccgactgctgttcaccctcggcggacgccttgagcacaccacggtcgatccggatgcaaaaggtaacgaacgttttgccaacgctgaccgcgccagcagtttcaccgctggcagtctgtcatccggcgcggtgtacacgctgacgccagtctggtcggtggctgcgacgctgggctacaccgagcgcgccccgacgttctacgagctgtacgccaacggcgcccacgtcgcgaccggcacttatgaagtcggtgatgccgggctgtcgaaagaaaaagccgtgtccagtgatctggcgttgcgttttgataacggcacgcacaagggcagtctgggggtgttctacagccacttctccaattacatcggcttgctcggtacgggccggacgttgaatgacgaaggcgaggaagacgcagacggcatccctgaatacacgtattccggcgtacgagcgcgcttcagcggtattgaagcgcaggatcgctggacgcttggcgaaaacgccttgggcaagtttgccctggaactgtccggcgactacacccgcgcgaagaacctcgataccggcgaagacttgccacgtatcgctccgctgcgattgaacagcgggctgctgtgggaactggacaagtggcaggcgcgcatcgatgttgaacacgccagttcacagcatcgcgtgccgactaacgaaagcagcaccgatggctacacgacgctgggcgccaatgtcgggtatcactttgatgtcggccagagccaatggctggccttcgtcaatgccgagaacctgaccaatcaaaccgtgcgttacgccagttcgattctgcgcgacattgcgccggcagaagggcgcagcattcaggtcgggttgcgcacaacgttctgataatcactgattgccactgtaggagctgtcgcggcccgagcctgcggcagctcccacacgggcgtgatcaggtggattgagccgtgtcgtcctccggcacgtcgtcaagaatgtcctcttgccccggcaattccgtaatcacactgaaatccgtcacttcaaccgcacccaggccataccccagcaaatggaaggaaaatgctttgcgctcttgcgggttgtcgaagctgaagttcatttgcagtggctgctcggcggttgcgaccatctcctgcggcagaccgatctgcacatcctgttcaaactccttggccttgagctgaatgtacgcggcctgctgcggatcgaccgagcgcacggtcaggcgtacgcgggtgtgcgagcctttgggcatttccaggtattgcgcgccgatcaggttgtcggcccagtcatccttgatctgcgcttgcagcgggataacgttggtgctgccgaactgatagcgatgattgagcggtgtgcgcagcagcgaaaggtcgagggcattggcgcgggcggcgatctgccgggccgggtggccgctgtagttacctttatagagggcattttcggcgatgaacccggcgctttcgtagtagcggcagcgacgcggcatgtcgcactcggaaaagatcccctgaccgttgtgatagcgcagcttgccgttggtgaacgacatgatttcgcggccgctgtcgtaatcgcgaaacagcgagcgaccgctcagcgcggaaggcaccggcaaatcgaagtaatcgagaatcgacgtactcagatcgacgtggccataaacgcctttgttcagtcgtggcagttgcgcttgctccggcgccagggtcagattgaagccccacgaagaagccagtcgcacgccgtcgatgccgtgggattcgtccgaggtgatcaccaccagcgtgtctttcagaacgccttggcgttcgaggccgttgagaaactgctccagcgcatcgtcgagataaccgacggcagcctgttttggcgtttcgaagcgctccagatattcctcgggcgcggagtagggctgatgggtgccgacggtcagtaacgtcagcatccacggctttttctgctttttcagttcgccgacatagtccagcgcgccctcgaaaaatgccttgtcatccttgccccacgggaactccagatagttgctgttggtgaaccactccagaccgtgcgtcgcatcgaaaccgatgtgcggcatgatcttgtctttggccatgaagcgcaggccggcaccttgcagatagtgcgtgctgaagccgtgttcacgcagttgcgccggcaggcacgcctgattgcgttcgttgagggtcagcatctccacgcctttgggcgtgccgttgttgagtttgtcgtagtcgccgcagagcatcgagtacagaccgcgaatggtctggtgggtatgcagcacgtaatccggggtgttcatgccgcgctcggcccagcgactgaggttgggcatcaggtcttcctgataatgactgccgatggcttcgcggttggcgcgaatgtaggcgccgggaatgccttccagggcgatgatcagtacgttgcgcgcttgcccaggggcggccagcagtttctgcccgttgaggtcgacgtcggtgagaccggccatggccggcgcgggttcttcgacatcgccgtccagccattcctcgccccgaatctgcagatcggcgacctcagtagccagcaactggtgcggcaggttgtactggcgccacggatccgcttcactcggccacaggttctgcgcgccccagtgcgcggcgaacaacaccagcggtgcgctccaggcggcgcgtggcaggggcgggcgcggtagatcgcggttggcaaaccgggttgccaaccagaacagcagggccagcagcaaggtgatacccagcgcaggatgcgccagcccgccaccggtggaattttccacgaactgcggatcgatcaggtaatgaatgtcggaaggcgtcggcagacgaccgacggcgctgaccagttcagcggtcgccacggccagcagtccccagaacagcaacaccggcaaggccagccaccacgcccggcgatgcagcaacacgaccagcaggctgccaatggccaggtccgacaaataacccagaggtgccgaccagcccagtgccgcacgcaggcacaccggcacaatcagcacgagaaatatcaacgaaaagaggcgggcatgcggctgccgcaaccggttaaaaagagcgctcacaaaaaagaccttccagccattaagtcgtcataaaagtgtgctcgatgataccaagggtgggctgtctgatcgcccttttaaacgctcaactgatgcgctggtgcgcgagctctcgaaggtgacgtcgcgcctgcagccctgatcggccctcgggtcaaacggcaatcggcgatattgctaccgacggatttattgtttcaggctgtttatgccgccaaatcatcaccggtatccaatgtagtaacagcgcaacgctgcgatctttctaaacctcggaatcaaaagcccgcaggctcattgcgctcaacaacccgtgctatcgatatgcgataaagatatttaatttctattttttatagcgataaagtcaggcctttcagcacaccacccccatgctgcgaggttgtcatggccacaccgttcaaacgttccgcactgactctattggccgcttccctggccgcgagttcgttgttcagcaccggcgctcaagctgagggcaagatcagcatcgctcaacaattcggcatcggttacctgattctcgatgtggtgcgcgaccagaacctcatcgaaaaacacggcaaagagcagggtctcgacatcaaggtcgactggaacagcatttccggcgccacggcgatgaacgaagcattgctcacgggatcgctcgacgtggtgtctgccggcgtgccgccaatgctcaccgtgtgggatcgcaccaaaggcaaacagaacgtcaaagccatcgccgcactgggctcaatgcccaactatctgctgaccaacaatccgaacatcaagaccctcaaggacttcactgacaaggaccggattgccgtgcctgccgccggcgtgggcttccagtcgcgcaccttgcagatcgaaaccgccaaggaattcggcgacgcgcagtacaagaaattcgacgatatctcggtcagcctgccgcaccccgatgcgacggctgcgctgattgccggcggctctgagatcaactcgcacttctccagcccaccgttccagtaccaggcgttgcagaatcctaacgtgcacaaagtgctgagctcctatgacgtgcttggcggccaggcgacgttcaacgtgctgtacaccacggaaaaattccacgacgaaaacccgaaaacctacaaggcgttctatgacgcgttggccgaggccgagaagatcatcaaggctgacaagccggcggcggctcaggcgtacattcgtgtcgagcagtcgaaactgccgctggccctggtcgagcaaatcgtcaaggatccggaaatcgatttcaccgtggtgccgcagcgcaccttcatctatgccgagaagttgcaggaactgggcgtgctgaagaacaaggccgacagctggaaggattatttctttgaagaggcgcatgacggcgcgggtagttgagcgaatggcatgaagcctcaagaatcatcttcaccgggcgataccagtggtcaacgtgcgccgaatcatctgattcggcgcaacgcatggattttttgacaggcacggtattaaagaatgctacggaaagtttgcagcacattggcaacctggggggctatcactctaagtgttgccgtattgaacgggtgcacgacggcgcgatacgacggtcagcgcgcgccggatccggccaaggctgtgattatcggctccatcaccgaaggctatctgactcagccgcacggcctgacggtcaacatcaaacagcagggagagccagacacagccattaccctgaccacgctgtacaacgaagacgaccagccgtccccgaacctgctggggcatctgttcatgtacgaggtgccgccaggacgctacgaattcatcgattggaactatcagttctatatggggcacgccgttgcccggccgtcctcgacggtattcaccgtgaaggcagggcagacgctttacatcggtaatctctacgccaatgcgctgacgtactgtttgtccaacgtcaatgatgccgaagaaaccgtcgagcgcctcaagggcaaatacccgatcctgcaaagccgcacgatcatcaatctgacctccgaaagcgccttcaaaccgtggcccacctctgatgccaaagacaacggcaaagggctttgcgttttttgaagcaccatcggcctggcacttttttccaaggaataaattgatgaatcgcaccgcactactttgggttggcctgctggccagcctgaccctgctcagcggctgtgccgccgggcctgatttgaagggacaaccattttttactgcagtggaacaggcgcaaccggaacaggcgacactgtacttctatcggcctgccgcgagtgtcggttacttcgtgaccccgacgattacgatcaatggaaacgccgtcggagttttaccttccggcgggtttttccggacaaccgtgccggccggttcctaccggatcgagtcgactactccgccatttgtcagcagcagcgtcaacaaacgcttcgacttgaacgtcgaaagcggccatgtctatttcatcgccgatgagaccagttcccgggcgttcggcgatgaccatgcgctgggcgaagtgaacgacgcctattattcgggcgcgcatttctacttccgttatgcattggtacctgcggaagaagcgttgcggacgatcaagtggtgtcagcaggtgccagtggccgtcaagtgatattcgaaaacggcagaacccggtcagtgttctgccaattcgtcccggtgttgtgctacttgctggtccttgcttcagcgccgaactcctggagcttatggaggcgcggtcacgccacctcttcgcgcttcaccaccagcgtcaaaatgtcataactggccaccagctccccgagctggtcggtgacttccacatcccacgccaccaccccttgcgcaatgccttgcgggctcttcttgccctggtcgatcttgcgtctgcaggtcaggcgcgcctggatggtgtcgccgatgcctaccgggttgatgaagcgcaaggtgtcgaggccatagttggccaacaccgggccgggggcggcggaaacgaacgggagtttggtcgaaccgtgatcgaggcttacaccgagctgaaatccgtgtgcatcgcccactgacctcaaaccctgtaggagctgcggcacgctgcgatcttttgattttgattttcaagaagcaggatcaaaagatcgcagcgtgccgcagctcctacagggggatcgtgtcaggcttcaccgtcgtcgaagatgctttctatgggcatttcaaatgtccgggcgatctggaacgccagcggcaaactcggatcgtaacgttcgttttcgatcgcattgatggtctggcgcgaaacgttcaagcgttccgccagatcgacctgcgaccatttgcgctcggcgcgcaattccttgaggcggtttttcattggtagcggcgtcgcgcaatttgcaggccgacaatccacatcagccccatcaccggccacacacatgtccatggaatatgcggggcgccgacgttttccagaaaaccgtagctgaaggtcaacagtgccgaggcggcgaaggcgaagcccagcgcttcgaactggatgcgcagatgcatttcatccatgcgccgcatgttgcgcacgatggcccagcacatcaggcctgctggaaggatcggggtcagtgccaccacggatcgcagaaaaatgttggcatccagcaggtattggctggcgatcagggaaaggctcaacaccagcacgtagagaaccaatgcggcgcccagttcgaggtagtagcggttcattcttcacttcctatgtaaaagaccttttacatcgtcgctgaagcattccttgatgtaaagcacgctttccatcagttcaaaaaaaacggggcggcatgatcatcaatcatgccgccccgcaggtgtttcagtcagtcagatcagtgcattttgctgtgatcgtgaccttccatgttggtcagcgcgcgaaccggcgctttgacttcgatggtttctttctcgcctttggcgttctcgacggtcagggtcagcggcacgctttcgccttccttgagctgaccggtcaggcccatcagcatcacgtggtagccgttcggatctagcttgacggctttgccggctggcagctcgacgaacttcaccgggcccatgctcatgacgtcattcttcatggtcatttcgtggatctgcacgtctttggccacgggtgtcgcaacgctgagcaacttgctgtcgctatcggcggtcagggtcatgaatgcaccgctggcggactgggtcggcacggtggcacgaacccaggcatcgtcgactttggtcgctgcagtcgcctggaatgccagacccagcagagaaaaaccgatgacagcgcgtttgatgtggttcagaacaggttgcatcagcaaacctccataacagtaagcaaatcttccgtgcattgttctgccgaaagcgaggtggacagaccgaggcgcaagccgccgttggagtcgtaaacgtaactggtggcggtgtgcgagatggtgtaggtgtcgccggccgggactttctcgtagaacacgtcgaattccttggccgtggccgcggtttcctcaagcgtgccgtacagcgcaacgaaggtcggatcgaaggctttcatgtaggcgtcgaggatttccggcgtgtcgcgctctggatcgaggctgatgaagatcacctgcaaacggtcgccatcggcgcccatcagcttcttgattttcgccgcgcgggcaagggtggtcgggcagactgccgggcactgggtgaaaccgaagaacaccatcggcatcatgccgcgaaagctcgacagcgtcatggtttcgccatcggtgttcttcagtttgaaggtgcgccccatgatcttgttactcagatccttgccgtacttgtacgacagttggccgcgggtgtcgcagccggcgagcaggccaagcccgagcacgcccattcccgcaagcaccttgcggcgagtcaacaaagccgtcatctaataccgccttttgcagcccgtcagtcggcaggactggcggggggttaaccgtaaaagcggcgcatgataccaaactgagaccagacgacggctgcggatcgccgtgcggtgtgggatcgagcgacaaaaggtgtaagaaaaagtgacgtaggctcactgcacgcgcgattcatctccccgccagccgccgcccagcgcggtgtacaggttgacctcggcgaccagttgcgcgagacggtcggtgatcaatccttgctgcgaactgaacagcgagcgctgcgcatcgaggaacgtcaggctgctgtcgacaccgttcttgtaacgattctgcgcgaggttgtaataggtctgcgtggcctcgaccagatcgcgttgcgcctgcaattgctgctgataggtggcgcgcgccgccagcccgtcggcgacttcctgaaacgccgtttgaatcgatttttcgtattcggcgacggcgacgtctttctgcaatttcgaataatcgaggcttgcgcgcaggctgccggcgttgaagatcggcaggctgatctgcggctgaaacgtccaggcacccgagccgccgccaaacagtccggaaaggtcgcgactggacgtgccggcgttcgccgtcaggctgacactggggaaaaacgccgcccgcgccgcaccgatattggcgttggcggctttgagtttgtattcggcctggagaatgtccgggcgtcgttgcagcaggtccgagggtaagccggcgggcagttgctcgaccagatcactggccagtggttgaccgggcaaggacggcgacaccggtgtgccgaccagcaaggtcaggctgttgagatcctgcgcgacctggcgctgatagcgcgccagattggcccgtgaactgtcgacgctggtttgcgcctgagcctgttccagtgccgaagatttgccagcatcgcgattgcgcgtggtcaggtgcaggctctgctcgtcggcgacgagggtgtcgcgggtcagctccagcagttcctggtcggcgcgccacgtcaggtaggcattggcgacgttggccaccagactcaattgcgcactgcgccgcgcctgctcggtcgccagccagctttgcagcgcctgctcgctgagactgcgcacccggccgaagaaatccagttcgtaggcactgatgccgaggttgaccgcgtaggttgaattgatcagcgctttgccttgggtcacgctcggcggcatgcgctggcgtgattcgctggcattggccgacaccgccgggtacaggtcggcacgctgaatgcggtactgcgcctggaacgcttcgacgttgagcgccgcgacgcgcaggtcgcggttgttgaccaaggcgctttcgatcagttgctgcagggcagggtcgttgaacagcgtgcgccagtcttcgctggacgttgctgcctgcgttggctgcggatattgcgcggcaaccggtgaagcgggccgctggtagtcgggtatcaaggagcagccggccatcaacatagctaaggacagcagagaaaatcgcaacgtcaacatcaaacagcctcgttcatgaaagagcggatgcctggagtgaataacccgtaagccagaccctcccccccgtaggagctgcggcacgctgcgatcttttgatcttgtttttaaacaaagcaggatcaaaagatcgcagcgtgccgcagctcctacaggggggggaagtcagtgggggattttgaacaggctcaggccccggccatccatttcgccagcccatgtcggccactgacccccagtttcgcggtggcgcgcttgaggtaggtctcgatcgaactgttcttgacccttaactgttgcgccatctgcggcaccgtgccaccggtcaggagccccaggcacacctccttttcgcgcaccgagagcacaatgccgctcagccccaggcgctcatcaaatacctgcgccagcggagcctgatccagttcagccaatggctggcgcggttgtcgggcgaggatttgccgactgatctgcgcatggcgctcgatcagcggcagcaaggtgtcggagaggctcttgagaaatgacagttccggcagggaaaacacgcgctgggtgtgtggtcggaaaaacgagatgacgcatcggcgattcgaggtgcgcgagaccagattgcactggtggacgctgtgctgcggatggcgtggctggagcgaggctttcagttggatcaacagtgagtcgttcatctcgatcatcttctgcaacaacggatgatcgtccggtcgctgcaacggggcgggcggcgggaaggtctgcacttggccggcgctgcccaacggcttgatctcgaccacgctggcctgacgctcatccagcgtccactcgctcagatcgacacggttgaccggtaccagcgtgtcgaccagctggaacatgttggtggcgaagtgatcgtcgcccgtgcttgcaatcagttctcccagttgccaataaaaaagcgggttttccatgttgcgaatgctgccggtcagattcatatccttgtcatccctggttcagagccatcactgaatcgtctgccgtctgtgtaaaagccgcccacgcagtcatttctccttgaacatgatccggagcaggatttaagcctatggatttgtcctacgtctgtaggggaaaacagggacacaaagtgccactatttttgaatcctggcgccggggttctggcggggccgatgagcggcgacgggtcgcaagtgactgttcagtcatgcagaggccgcgaaaaccggggattggccaaggccgatcggcggcgttcaggcaaatggcggcgttgctatgtggttcttttcctacaagcttttcagaatttcctctccgaacttgtaggcagtgcctgcgcttaccgcgacagtaagaccaaacaggcgcgtgcagacgttgtggttgtccgggtttcaggtgtcatgtcggtgccggggccgatgcttgaatacgcggcaaattacatgagatggatcttatgccgcctatttctgccaacgtggcggacgatcagtccgcgcctgtcgagacgtaccctctgactgccgcccagcgggatatctggctggaccaacagagtcgcggagattcgccgctgtataacattggcggttatgtcgaactgagcgggccgctggacccgctgttgctgcaatcggcacttgaacggctggtagccgcaaacgatgccttgcgcattgttctgtcaacgaacgttggtcacgatgggttgccgctgcagaagtttgcgcaggatttgccggtggccatgccgctgcatgatttcagccagcacagcgatccacggtcggccgctcaggcgctggtggaaaagcacatggcgcaggcttacacattgagcggacagccgttgttccgtttcagcctgattcgccttgatcgtcaccgtcactggctggcggcgcaggcccatcatttgatcatcgatggctgggggttcggtctgctgttcaagtcggtgggtgaaatctacagcgcgttgtgccgtgacgagcagccaaacgtagcggcgccgtcctatgtcggcttcatcgacgatgatgcgtcctaccagcagtcatcgcgttacgaactcgatcaacgctactggctggacaagtaccgcagcattcccgaacccttgttgactccctgtcatcgcgaacccctcggcgctgaaatggcaccagggcaaatccatgtcgaggcttttccgacgctgttgcacgagcgcatgaaagacacgtcacggcagttgggcggctcggcgtttcatgtactgctggctgcgctgcacgtgtatttcagtcgtactgcccaacgtgacgagtgggtggtcggcttgccgatcctcaatcgctccggtgcccgcttcaaaggcactctagggttattcacccaagtcagtgcaatgcgcatgggctttggccgaacactgtcatttggcgatttgatcaaggcgataggcactggcctgaagcaggatttccgccatcaacgctatccactgagcgagatgaaccgcgcgctgggcctgttgcgtgaagaccgctcgcaactgttcgagctgtcggtgtcctacgaacaagacgaccatgactaccgttacggcgatgcgccggggcacgtggtcaaggtctccaaccagcacgaagcgacaccgctggccattcacctgcgcagtaaccgctacaacgacaaggcctggctgcatctggtgtactcgccggcctatttcacggcagacgagatcgcatcgtttaccgagcacttggtgctgatcctggagcaaggcctggagtctcctgaacggatcgtcgccgatttcaacctgatcagcccggcacaactcgcccggttgaatgagtggaatgacacccgagtcagctatccgcaaaaccagaccattcatcaacgcttcgagtcgcgcgtggctgaacagccggacgccgtggtcgcgacttatcaggggcggtcgctgagttacgccgagctgaaccggcaagccaatgcgctggcccatcatctgctgggcctcggtgtacggcccgatgaccgggtggcgattgttgcccgcagaggcctggaaagcttggtcgggctgctggcgattctcaaggctggcgccgcttatgtgccgattgacccggcgcatccccccgagcgcctgagttatctgctcagcgacagcgctccgatggcgctgctgacgcaaagtgatgtgcgcgagcgcttgcctgccacagcgctgccggtgattgagcttgatcggcgcgagtgggcgctcgacagcgtcaccaatcctgaggtggccgggctgaatcctggcaacctcgcctacgtgatttacacctcgggctcgaccgggttgcccaagggcgtgatggtcgagcaccgcaccttgtgcaatctggttgactggcactgcgaggctttcggcttcggcccagggcagcacacgtcgagcctggccgggttcggtttcgacgcgatggcgtgggaggtctggccagcgttgtgtgccggggcgacggtgcatttttcacccgcgagcgacggcagcgaagacattgatgcgctgctcgcctggtggcgtgcgcagccgctggacgtcagcttcttgcccacgccgattgccgaatacgccttcagcaaacaactcgatcacccgaccttgcgcaccttgctgatcggcggcgatcgcctgcgccagttcaaccgcgcgcagggttttgcggtgatcaacaactatggcccgaccgaagccacggtggttgccacttcaggactgatcgcaccggggcaggcgttgcacatcggcaaaccagtcagcaatgccacgacttacctgcttgatgatcaacagcgcccggtgccgatcggcatcattggcgagttgtatgtcggcggcgcgggggttgcacggggctatttgaatcgcccgcagttgacggccgaacgcttcctcgacgacccgttcagtgcgcagccggaggcgcgcatgtatcgcaccggcgatctcgcccgttggcgcgccgacggcaatcttgaatacatcggccgcaacgatgaccaggtcaaagtccgtggtgtgcgtgtcgagttgggtgaaatcgaagcggcactcgccagccatgatgctgtgagggaagccgtggtgctggtgcgtgacggccaactgttggcgtggttcaccgaacgtgaatcgctggacatcctgcaactgcatgcgcacctgacctcgcgcttgccagccgccatgttgccggccgcttacgtttgtctggcgagtctgcccctgacggccaacggcaagcttgaccgccaggccctgccgccaccggggccggaagcgttgatccgtcgcgaatacgaggcgccacagggtgacgtcgaaattgccctggcgcagatctgggccgaagtcctgcaggtcgaacgggtagggcgtcacgatcatttctttgagctgggcggccactcgttgctggccgtcggcctgatcgagcgcatgcgtcagatcggcatgagcagcgatgtgcgggtgctgttcaaccagccgacactggccgcgctggctgcggcggagggcagcggccgcgaagtcgcggtgccggccaaccgtattgccgccgattgcacgcacatcacgccggacctgctgccactggtgcaactcgatcaaacgatgatcgagcgtatcgtcgcaaccgtgccgggcggtgccgccaatgtgcaggacatctacccgttggcgccgttgcaggaaggcattctctatcaccacatcaccgccgcacagggcgatccgtacctgctgcaatcactgctggcgttcgataccatcgagcgggtcgaggccttcgccgctgcgttgcgtcaggtcatggcgcgccacgacatcctgcgcacggcagtggtctgggaagggctgacgtcaccggtgcaggtggtgtggcgcgaggcgattttgccggtgcaggaggtcgaactggatcctgctcacggcgcgatcatcgatcaattgcacgagcgttttgacgcgcggcgctatcgcctcgatgtgagtcaggctccactgctgcgcctgatgtttgcccgcgattccgcgcataaccgcgtggtcggcatcttgctgttccaccacttggcaatggatcacgtcgcactggaggcgatgcgcgaagaaattcacgccagtctgtccgggcacggcgaaccgctggcagcaccggtgccgtaccgcaactacgtggcgcaaacgcgcctgggcgtcagcgagcaggagcatgaagcgttctttcggcagatgctcggtgacatcgacgaaccgaccttgccgttcgcgctgcagaacgtccagggcgacggcagcaacatcgaagaagccgagcaagccgtggcgcccgaactctatcaacgcatgcagcagcaggcacgtctggccggcgtgagcgttgccagcctgatccacctcgcctgggcgcaggtgctggcggcgacgtccgctcagcaaagtgtggtgttcggcacggtgctgatgggccgcatgcagggtggcgcgggcgccgaccgtgcgctgggggtgttcatcaacaccttgccgctgcgcgttgatgtcggcgaaggcgcgcgcaacgcggtgaaatccacccatgcacggctgagcgctttgctcggccatgaacatgcctcgttggcgctggctcagcgttgcagtggcgttgccgcacccgcgccgctgttcagcgccttgctcaactaccggcacagcgatgatgtcgagcaagacacctcccggcaaacctgggagggcatcgagacgttggtcaacgaggaacgcacaaactacccgtttaccttgagtgtcgatgacttcggcagcggcttgcggctgaccagcagaaccttgtcgagcattggcgcgcagcggatttgcgcttacgtgcaggccgctttgagcggtttggtcgaggcgttggaaactaccccgcaacggccgttgaacagtctgccgttgctgccgcaacaggagctgcaacagctgctgttcgagttcaacgatacggcagtcgattgcccgatggagcagccgctgcaggcactgttcgaacaacaggttgtgcgtaaaccggatgccgttgcggtgcaatttgccgagaagtgcctgacctatcgcgaactgaacgagcaagccaaccgcttggcccatcacctgcgcgggttgggcgttcagcctgattcgcgggtagcgatttgcgtcgagcgcgggccggagctggtggtcggtctgctgggcattctcaaggctggcggtgcgtatgtgccgctcgatccggattacccgctgcaacgcctgaactacatgctgcaggacagcgcgccggttgcgctgctggtacatgccgcgacgcgcgatctgctcggcgaacccggcgtgccgctgatcgatctcgacctcggcgcctggcaggaccagccgcacgataatccgcaggtggcgggtctcggcgcgacgaatctggcctacatgatctacacctccggctccaccggcaccccgaagggggtgatgatcgagcaccgcagtgcctgcaacatggtgcactggggctcgcagttggcgccgcccaccgaacacggcgcgttgctgcaaaaggccccgtacagtttcgacagttcggtgtgggagatcttctggccgctgtgctcgggcatgcgcctggtccttgcgcgcgccgatggcaatcgcgattcggcctatgtgacgcaagtgattcgcgagcagaacatcaccgtggtcaagttcgtcccggcgctgttgcagcagttcatcgaacaggacgacgtcagccagtgcaccagcctcaccgacgtgctcaacggcggcggcgaattgaccgtcgcgctggcccggcaagtgcgtgagcgcctgccctgggtgcgcctgcacaacgtctacgggccgaccgaaaccacggtcgacagcagcggctggacgctggaacccggcgagccgctgccgccgacaccggtgccgatcggcaaggcgctgagcaacacgcggctgtatgtccttgatgcctgcgatcaaccggtgccgcttggcgtcagcgggcatttgcacattggcggagtgggcgtggcgcgcggctacctggggctgccgcaattgcaggccgagcgttttatcgacagcccgttcgtggccggtgatcgtttgtatcgcaccggtgatctggtgcgttacgacgctgacggcaatctccagttcctcgggcgcaatgactttcaggtcaagctgcgcggggttcgtcttgagctgggcgagattgaagcgcggctgcttgagcatccggccatccgcgaagccgtggtgctggtgcgcgatgagcgactggtggcttattacagcgtccgtgccgagctggctgcaccgacgcttgaagcattgcgcgcgcatgtgctggcgcagttgccggagttcatggtgcccggcgcttacgtgctgctggcggcgctgccgttgacgcccaacgacaaaatcgatcgcagggcgttaccgcaaccgggggcggaggcgctgctcagccggccttatgccgcgcccgaaggcgacgtggaaagtgccttggcgcagatctgggcgcaggtgctcaaggtcgagcaggtggggcgcgacgacaacttcttcgagctgggcgggcactcgttgctggcggtcagtctggtggcgcgcatgcgtctggccgggctgcatgtcgatgcgcggacgctgttcagccagccgacactggctgcgctggcggcccagacctcgcggcaggccaggcaggtcgaaatcgccccgaccaccatcccgagcctcaatcgcaaacgccgtctctgacggcgaccacaaaccctgtaggagtgagcctgctcgcgatggcgtcaggtcaggcgatatgttcgtgactgacacaccgcaatcgcgagcaggctcactcctacaggggccggttgtgtggcccagatcctatatggcttgtccccgcttcccatgtcagacacccacgccccgatgttttagtttttccaggctgcgcgccgcgtgcacggactcgctgctgcgcgctcctttttttcgtatttacagcaggttacctcatgcatttcagcgaactgatggctgttatttccacccatgcgatccgccttcaacaggaagatgaagacctggtcattctgggcagcgacgacgcgctggatgacgcgttgtgggacagcctctcggcgcacaaggcgcaattgctggaactggtcgcccagcatggcggcgactggctgagcccggcctttcggatcaccccggacatgctgccactggtgaatctgcagcaggatgccctcgaccgcatcattgccacgctgccggggggcgccgccaacgtgcaggacatttatccattgtccgcattgcaggagggcatgctgtatcaccatctctcggcggctgccggtgatccttacatttcccaggcgcggttcgtgttcgacagccagcagaggctggacgccttcgccgacgcgttgcgctgggtggtcaagcgtcacgacattctgcgcacctcgtttgtctgggaatatctcgacgaagcggtgcaggtggtctggcgcgaggcgccgctggtgtgtgaggtaatcagcgtcgacagcgagcgcgatgtgctcacgcagttgctcgagcgtcacgatccgcagcactttcgcctcgatatgcagcgagcgccgctgctgcgcatggtctatgcgcaggatcccgcgcagggccgagtcgttgcgttattgctgtttcatcacatgatcatggatcacgtcgcgctggatgtgttgcgtcgggaaatccaggcctgtctgctcgggcagactgcgcaagtgcctgcggcggtgccgtatcgcgatcatctggccatggcgcgcagtgccggcaatgagcaggcgcaggaagcgtttttccgcgagatgctcgccgacatcgacgagccgacactgccgtgtggtttgcaggatgtgcagggtgacggccacgctatcgaggaagcctcgttgctgctcgccagccacttgagccggcagtcgcgcgagcaggcgcggcagctcggcgtaagcgtggcaagcctgttgcatctggcgctggcgcgggtgttggggcaattgtccggacgcacggcggtggtgttcggcaccgtgttgctgggacggatggacgcgggcgagggcggcgagcaggcgctggggatgttcatcaataccttgccgctgcgcgttgatgtcggtgagcaaagcgtgcgcgctggcgtgctggcgactcatcggcgcctgaccgctttactggcccacgagcaagcttcgctggctttggcgcaacgttgcagcgccgtcgcggtgccaacgccgctgttcagcgcgattctcaactaccggcacagcagcgtcgaagaagtcgctgacgtggtcgatatcgcccccggtgtgcaggtattgggtgcccgcgagcgcaccaactatccgctgaccatcaatatcgatgacctcggcgtggatttgcgcatcactgcgttggcggatgcggcgctgggtgccacacgcgtggcggcttacttgaacaccgcgctggaaagtctggtcgcagccctgcaaaactcgcccgacgcagcgttgcatacgctgcacattctgccgaccagcgaacgcgaacacctgttgcgtggcgccaatctaccgctgacgcagttcctcgaaaccccactgatccaccagcagttcgaagcccacgcacaggctcgacctgacgccacggcactgatgttcaacgggctgacactcagctacggcgagctcaatcgccgtgccaaccaggtcgcccattaccttctggcgctgaacattcgtcccgatgatcgtgtggccatctgcgtcgaacgcggcccgcaaatgatcatcggcctgctcggcgtgctcaaggccggcgccggttacgtgccgatcgatccggcttatccgctcgacagaatcagtttcaccttgcaggacagcgccccggtggcggtgctgatgcaagcggcgacgcgtgatcgcgtggccgctctcgaggtgccgcagatcgacctcgacagcgctcacctcaaggccgaactcgacagcaatccgcagattcccgggctgaccccggcgcatctggcgtatgtgatctacacctccggttccaccggtttgcccaaaggcgtgatggtcgagcaccgcaacgtggcgcggctgttttctgccaccgatgactggttccagttcagtcagcaagacatctgggcgctgttccattcttttgccttcgacttttcggtatgggaaatctggggcgcgctggcgttcggcgggcaattgctgttgatcccgcaagccgtcagccgctcgccggacgactgttatgcattgctttgcgaaaccggtgtgaccgtgctcaatcagacgcccagcgccttccgccaactgatcgccgcgcagggtcgcagtcagttgcagcattccttgcgggaagtgattttcggtggcgaagccttggagccgggcctgctcaaaccgtggtacgcgcgggtcggcaatgccggtacacggctggtcaacatgtacggcatcactgaaacaaccgtgcacgtgacctatcgaccgttgcaggccgccgacgctctgttggtcggcgtcagcccgattggtgtgcgcattcccgacctgcaactgtatgtcctcgatgctcagcatgaaccggttccggtcggcgtgatcggcgagttgtacgtcggcggcgccggggtggcgcgcggttatctgaatcgtgaggcgctaacgagcgagcgctttatcaatgatccgttcagtgaaaatgccaatgcacggttatacaaaaccggcgacctggcgcgttgggccgccgacggcagcatcgaatacctggggcgtaatgacgatcaggtgaaaattcgcggtttccgcattgaattgggcgaaatcgaagcacgcctgtctgcctgcgcaggtgtgcgcgaagcggtggtgattgcccgtgaggacagccctggcgatcagcgtctggtcgcctattggctggccgacgaaggcgccgcaccggatgtcgcgcaattgcgcgatcaactgctggtgtcgctggctgagtacatggtccctagcgccttcgtgcgtctggacgctttgccgctgaccgccaatggcaaactcgaccgcaaagccctgccggccccggacagcgacgccttcgcctatcgtggtttcgaagcgccggtcggttcagtggaaaacctgattgccgggctctggcagacattactcggtgtcgagcaggtcggccgccatgacaatttcttcgaactcggtggtcattcgctgctggcggtgaagctgatcgagcgtatgcgccaacaggatttgcattgtgacgtgcgcgtactgtttggtcagccaagcgtggcagcgctggcggcgaacttgaacagcgaacgtgccatcgtcgttcccgacaacctgatcgaaccgggttgcacgcgcattactccggcgatgctgccgctggccaatctcgatcaagccgcgatcgaccgtgtcgttgcaacggtgccgggcggcatcgccaatgtgcaggacatctatggcctggcgccattgcaggcagggattctctatcaccatctggcgaccagcgccggtgatccgtatgtgttgcaggcgcaattcgccttcgacggtttgccacagatcaaagccttcgttcgcgccttgaacggtgtgatcaaacgccatgacattctgcgcaccggcgtggtctgggaagggctcgaagaggccgtgcaagtggtctgccgtgaggcgccgctggcgctggaacgcgtcgatgccgatgaactcgacggcgacgtgctggaacagatgcaggcgcgtttcgatccacgccactaccgtctggacctcaatcgcgcgccgctgatgcgctttgtctacaccgaagatcagccgcacgagcgctggatcggcattcttctgctgcaccatatcgtcctcgatcacacggcgctggaagtgctgattgcggaaatgaacgacgtcatgcttggccgcagcagcgacttgccgccgccggtgcaataccgccactttgtcgcacaggcgcggctcggcgccgatgatcaggcgcacgaggcgttcttccgcgcgatgctcggcgacattgacgagccgaccgtggcgttcggtctgcaggacgtgcacggcgatggcagcgatatcctcgacagtcatttggaacttgatggcggcctcggccagcgtttgcgcgagcaggcgcggcgcttgggtgtcagcgtagccagtctggtgcaccaagcctgggctcaggtgctggcgcaggtttccggtcagcagaacgtggtgttcggcaccgtattactcgggcgtatgcagggcggagagggcgctgatcgggcgttgggcatgttcatcaacaccttgccgctgcgcgtcagcgtcggtgtcgagacggtggagagcggcgtgcgtggcacccatgcgcgcctggcgcagttgctcggccatgagcaagcctcgctggcgctggcccaacgttgcagcggtatcgccggttcgcagacgctgttcagcaccttgctcaactaccgccacagtacgccggaatcggccgctgtagcgtgggacggcgtgcagattctcagctcgcgcgaacgcagcaactatccgttggtggtcagcgtcgacgacctcggcgaaggtttccgcttgagcgtacaagccgtgccgcaagtagacggcgcgcgggtttgtgattacctgcaaaccgccttgcacagtctggtcacggcccttgagtacacgccgacggcgccgttgcagcaactgacgatcgtgtcgccaagcgaacgccaacgggtgctggtcggcttcaatatcagcggtcgtgaatacccgcccgcgcagaccgtaccgcgtctgttcgaagcgcaagtcgcggcgcggcccgaggcgctggcggtggtgcagggcgagcaacagttcagctactgcgaactgaatcagcgcgccaatcgcctcgcccatcacctgaccggcctcggcgtgcaggtcgatgaccgtgttgcgctgtgcctgcgtcgcggcccggacatgctcgttgcgctgctggcgattctcaaggccggcgccggttatgtgccgattgatcctgaatacccggctgaacgcatcgcctacctgttgcaggacagcgacccgatcgcggtgctggcgcaggcctcgacgcgcgacctgcttggcgctgtacccgtgatcgatctcgacgccaacgactggcggcacttgcctgacaccaacccggccctgtcgaggctgactccggcgaatctggcctacgtgatctacacctcgggttccaccgggcagccgaaaggcgtgatggtcgagcaccgcactctggaaaacctcgtgcactggcacgccgaagctttcgatctgcacgccggcagccacaccgccagcgtcgccggttgcggtttcgatgccatggcctgggaagtctggccggcgttgtgcgtcggcgcgactttgcatctgccaccgtcatcgatcaaaaacgaacacctcgatgaactgctcgaatggtggcgcgcgcagccgttgcaggtgagttttctgccgaccccggtggccgaatacgcgttcagtcgcgggctgggccatccgaccctgcgcacgctgctgatcggtggcgacaagttgcgccagttcccacgtgagcagaccttcgccgtgatcaacaactacggcccgaccgaagccacggtggtggcgacgtccgggcgcattgagcccggccaggttctgcacatcggccggccgattgccaatgcgcgggtttatctgctggaccgtcagcaacaacccgtgccgagcggtgtgcagggcgagttgtatgtcggcggcgccggagttgcgcgcggctatctgaatcgcccggaactgaccgctgcgcagttcctcgacgatccgttcagcgacgagccgcacgcgcggatgtaccgcaccggcgacctcgcgcgctggctggacgacggcaatatcgaatacctgggacgcaacgacgatcaggtgaaactgcgcggtgtacggattgagctgggcgaaatcgaggcggcgctgaacgcacatgatgcgatccgcgaatgcgtggtgctggtgcgcgacggacgattgctcgcctggttcacggaaatcgcgtcggtcgagatcagcgccttgtaccagcacctgcaagcgcgactgccggacaccttagtgcccgcggcatacgtgcgcctgggcagcctgccgctgaccgcccacggcaaactcgaccgcaaggccttgcccgagccggatcaggacgcgtggctcagccgtgcatatgaagcgccgcaaggcccggtcgaaacagcgttggcgcagatctgggccgacgtactcaacatcgaacagatcggtcgccacgacaatttcttcgaactcggcggccattcgctgctggcggtaagcctgatcgagcgcatgcgtcaggccggtctgagcgccgatgtgcgggtgctgttcaatcaaccgagcctcgccgcgcttgcgcgtgccttgggcagtggccgggaaatcaaggtgccggccaatctgattgcggccgtttgcacacacatcaccccggacatgttgaccctgaccacactggatcaggccagtatcgatcgtatcgtcgctacggtaccgggtggcgccgccaatgtgcaggatatctacccgctggcaccgctgcaggaaggcattctttatcaccatttgagtgccgagcagggcgatccgtacctgctgcaatcgcgtctggccttcgacagcctcgaacgtttgcagactttcgccgcacacttgcagcaggtcatcgaccgtcacgacattctgcgcaccagcgtggtctgggaaggcctgcccaacccgcagcaggtggtctggcgtgaggcgcagatggtcgtgcagcaagtggggctggatgcgcaggacggcgacattctcgaacagttgcacgcacgtttcgatgcacggcattaccgcctcgacctgaatcaggcaccgctgatccgcatggtctacgccgaagatccgttgcagcagcaagtggtcgctatcgtgctgttccatcactcgattctcgaccacaccgcgatggaagtgatcggccgggaaatgcacgcgttgatgttcgatcaactcgacacgctgacgccgccgatgccctaccgcaactacgtggcgcaggcccgcctgggcgccgacgagcaggagcacgaagcgttcttccgcgagatgctcggcgatatcgatgagccgagcttgcccttcggactacaggatgtgcagggcgacggccgcggcatcgaagaagcgctgcagccggtcgatgccgcgctcaatctgcgtttgcgtgaacaggcccggcaattgggcgtcagcccggcgagcctgatgcacatggcctgggcgcaggtgctgggcgtggtctgcgggcgccgcgacgtggtgtttggcaccgtgttgatggggcgcatgcagggcggtgagggcgccgatcgcacgctgggggtattcatcaataccttgccgctgcgcgtcgatctcgctgaaggcgtgcgcgccggagtgaaaaccacgcacgcgcggctgacggcgctgcttggccatgagcacgcctcgttggcgctggcgcagcgctgcagcgccatgaccggttcgacgccgctgttcagcgcgttgctcaactatcgacacagtgccgccgagcagcagccgcacgacggccagggcatctggcaaggcgtgcgcatgctcggcggcgaggaacgcagcaattatccgctgaccctgtcggtcgatgatctgggcgaagcctttgccctcaatgtgctcgcggtcgcagagatcggcgcgcaacggatttgcagttacatgcacaccgcgctcgagcatctggtgacggcactggaagaggcgccgcaacgtccgctcaaccgtttgccggtgcttccggtggcggaatacgaacacttgctggtcggcttcaaccagcactcagcggcctatccgcgtggcacgacgattcagcgcttggtcgaggcgcaggtcgagcggcagccgcatgcactggcagttgttcaaggcgcgcagcaactgacctacgcgcagctcaatcagcgcgccaaccgtctggcccatcacttgctcggcctcggcgtgcagcccgatgaccgcgtcgcggtgtgcctgcgccgtagcccggacatgctcatcgcgttgctggcgatcctcaaggccggcggcggttatgtgccggtcgatccggcgtatccggcagaacgcatcgcctatctgttgcaggacagcgcgccgatggcggtgctggcgcaggcgtcgacggctgatttgcttggcgccgtgccgctgattgatctggacaatcccacttggcagcacttgtccgagagcaatccgcaactgccgacgctgacgtcagcgcaccttgcctacgtgatctacacctccggctccaccggccagccgaagggcgtgatggtcgaacacgcgacgctggaaaacctcgtgcactggcactgcgaagccttcgacctgcgcaccggcagccacacgtcgagcgtcgccggattcgggtttgacgccatggcgtgggaggtctggccggcgttgtgtgtcggcgcgaccctgcacctgccgccgcagtcggtaagcaacgagcatctcgacgagttgttggcgtggtggcgtgcgcagtcgttgcaggtgagtttcctgccgacgccggtggccgaatatgcgttcagtcgcgaactcggccacccgaccttgcgcacgctgttgatcggtggcgacaagctgcggcagttgccgcgtgaacagaccttcgcggtgatcaataactatggcccgaccgaagccacggtggttgccacctccggcgcggtcgaggccgggcaagtgctgcatatcggtcggccaatggccaacgcgaaggtttacctgcttgacgaccagcagcgccccgtcccggtcggcgtcgctggtgagttgtatgtcggcggcgccggtgtggcacgcgggtatctgcatcgccccgagctgactgccgagcgcttcctcgacgacccgttcagcgacgaaccgcaggcgcgcatgtaccgcaccggcgacctcgcacgctggctcgctgacggcaccgttgaatacctgcggcgtaacgatgatcaggtcaagttgcgtggcgtgcgcatcgaaccgggtgaaatcgaagcggcgttgagcgctcacgaggccgtgcaggattgcgtggtgctggtgcgcgacggccagttgctggcgtggtttaccgaacgcctgagcgtcgacatcgaggacttgcgcagtcatctgcagacgcagttgccgcaagccctggtgcctgccgcttacgtgcgcctgcgagcactgccgctgaccgccaacggcaaactcgaccgcaaggcgttgccggagccggatcaaacggcgtggctgagccgcgaatatgccgcgccgcaaggtgcggtggaaatcgcgctggcgcagatctggtccgaagtccttaacatcgagcaggttggccgccacgacaacttcttcgaactcggcgggcattcgttgctggcggtgacgttgatcgaacgcatgcgccaggtcgatctgagcaccgacgtgcgcgtgttgttcagccaaccgacgctggctgcactggcggcggcggtgggcagtgggcgcgaggttgcagtgccggataatctgattccggccgattgcacgcacatcactgcggacatgctgccgctggtgcaactggatcaggccagtgtcgagcgcatcgttgcgaccgtgccgggcggcgcggccaatgtgcaggatatttacccgctggcaccgttgcaggagggaattctgtatcaccacctcagcgccgcgcagggcgatccgtacctgctgcaatcgtgcctggcgttcgacagcctcgagcgttttcaagggttcgcggcggcgctgcgtcaggtcatgacgcgtcacgacatcctgcgcacgtcgattgtctggcaagggctcgcggcgccggtgcaagtggtctggcgccatgccgagctaccggtccaagccgtggagcttgagccagcgcagggagaggccatcgaacagctgcgtgctcgcttcgatgcgcggcactggcgaatggacttggaccaggcaccgctgctgcgtctggtgtatgccctcgatcccgataatcaacgcgtcgtcgccatgctgttgttccaccacatcgccatggaccacaccgcgttggcggtggtcagtgaagaaatgcaggcgattctgcgcggcgatgagcgattgccggaggccgccgttccgtaccgcaattatgtcgcgcagacccgccttggcatcagcgagcaagagcacgaagtgttcttccgcgaaatgctcggcgacatcgacgaaccgacactgccgttcggtttgcaggacgtgcacggcgacggcaatgacatcgaggaagtcagccaagcgctgcccgccgtggtggcgcagcgtttgcgcagtcaggcgcgcttgctcggcgtcagcgtcgccagcctgttccatctcgcctgggcgcgggtgctggcggcaacgtccggccaggaacgggtggtgttcggcacggtgctgcttggccgcatgcagggcggggcgggcgcggatcgcgggttgggcatgttcatcaacaccttgccattgcgcgtggatgtcgatgagtccgacgtgcgcgccggagtcaaggcgacccatgcgcggctcagtgcgctgttggctcacgaacatgcgtcgctggcgttggcccagcgttgcagcggtgtcgccgcgccgtcgccgttgttcagcgcaatgctcaactatcggcacagcgacagtgaggcccgtcagaacgccaagcgtgaatcctggcagggcatcgaatccctggccggcgaggagcgcaccaattacccgttgaccctcaacgtcgacgatctgggcagtggcttccaactgacggtgatgaccccatcgcgcatcggtgcggcacgtatcggccagttcatgcagaacgcgctgatcgcgctggttgaagctttgcagcacaccccccagcaaccgctgaaccgcctgacggtgttgccggaggaggagcggcaggcgttgctgttcggccgcaacgacaccgccgtcgattacgatttgcagcagacgcttcatggcttgttcgaggcgcaggtgcagcgtacgccggaggctgtggccgtcgttgccggcgaacaggcattgagctatacgcaactgaacgaacgcgccaaccgcttggcccggcacttgatcagcctcggcgtgcaagtggatgcacgggtggcgatctgcgtcgaacgcagtctggaaatggtcatcggtctgctggcgatcaacaaggccggcgccggttatgtgccgctcgacccggcctatccgccggaacgtctggcctacatgcttgaggacagcgcgccggccgtggtgctggtgcaccgggcgacccgcgagttgctggcagacatctcggcaccgctgattgatctcgaccagaacacctggcaatcgctgtctgccgacaatccgaagatcccggatctgacgccgcaacacagcgcctacgtgatctacacctccggctcgaccggccagcccaaaggcgtggtcaacgaacatgccggtgtggtcaaccgcttgttgtggatgcaggacgcttatcgcctgacggctgccgattcggtgttgcagaaaactccgttcagtttcgacgtgtcggtttgggagttcttctggccgttgatgaccggcgcgcgactggtcatggcgcggcccgacgggcacaaggatccgcaatacctgagcgaagtgatcgagcgtgaacacatcaccacgctgcactttgtgccgtcgatgctcgacgtgttcctcgccaacagcgacaccgcgcgctgcgacggcgtgcgtcgggtgatgtgcagcggtgaggcgctgccgggcagtctggtgcggcgtttcaaactccagttaacgggcagcgagttgcataacctctacggcccgactgaagccgccgtcgatgtcactgcgtggaactgcgccgggcctatcgaacagactccggacaacacgccgatcggcaaaccgatcgccaacacccgcctgtacatcctcgatgcgcaacaacaaccggtgccgcaaggcgtagtcggtgagttgtacatcggcggcgtgcaggtggcgcgggggtatctgaaccgacctgagctgagtgccgagcgcttcctcgacgatccgttccagccgagcgggcggatgtatcgcaccggtgacgtcgcgcgctatcgggcggacggcaacatcgagtacctgggtcgtaacgacgatcaggtgaagatccgtggcttgcgtattgagctgggtgaaattcaggcgcgccttgcccggatcgaaggtgtgcaggaggcggtggtggtcgcccgcgaagacgtgccgggcgacaaacgtctggtcgcgtattacaccggtgaacggctggaaatcgacgtattgcgcagtcatctgctcgagcacttgccggattacatggtgcccgccgtgttcgtgtatctcgacgctttgccgctgagccccaacggcaaactcgaccgcaaggcgctgccggctccggatcagcaatcgctgaaagcacgcgaatacgaagccccggtcggtgaagtcgaaatcaccctcgcacggctctgggccgaactgctcaacgttgaacgggtagggcgtcacgaccacttttttgagctgggcggtcactcgctgctggcggtcagtctgatcggccggctgcgtcaggaaggcatggaggccgacgtcagggcgttgttcgaacaaccgaccctggccggctacgccgcaattacggaaagaatggagatcgtcctgtgaatgtgctcgaactgttggcaaccctgaaggcaaaagacattcagttggcggtgaccgatgagcaattgcgcgtaaacggcaacaaacaggcattgagtgatccggcgttgctggccgcgctgcgcgagcacaaaccggcgctgatcgaactgatcaaggccggccagtactcggccagccgggtcggccagatcgacgtgccggccaacggcatccttcccggcagcacgcgaatcacgccagcgatggtgaccctggctgaagtcgatcagccaactctcgaccgcttgatcgccgacgtaccgggtggcgccgccaatgtccaggacatctacccgctggcgccattgcaggaaggcattctctatcaccatgcgagcaacgagcagggcgatccgtacgtcatgcaatcgtacttcgcgttcagcagccgtgagcgtttgcaggatttcgctcaagctttgcaaaaggtcatcgatcgccacgacatcctgcgtacggcggtgcattgggaagggctggacgtgccgctgcaagtggtctggcgccaagcgcagctgccaatggaagaagttgtggtgcaagacggcgaaagcgctgtgctgcagcaattgcacgagcgcttcgatgcgcggcatttccgtctcgacgtcaagcacgcaccgatgatgcgtctggcctatgcatgggatgaggccggtcagcgcgtagtcgcaacattactcttccatcacatggccctggaccactcggcgctcgacgtggtgcgtcacgaactgttcgcctgcctcaccggtcaggatgaattgctaggacggccggtgccatttcgcaattacgtggcccaagcacggctgggcatcagcgaagccgagcacgaggcgtttttccgcgagatgctcgcggacattgccgagccgacgttgccctatggtttgcaggacgtgcagggcgacggcctcggtatcgccgagctgagcctgccggtcgatccgctgctcggccagcgtctgcgcgcgcaggcgcggcagcttggcgtgagtgccgcaagcttgttccatctgggctgggcgcaggtattggcggtggtcactggcaagcagaatgtggtcttcggtacggtgctaatggggcgcatgcaaggcgctgaagccaccgaacgggcgttggggattttcatcaacaccttgccgctgcgggtcgatgtcgatgcgcagggcgtgcgtgcggcggtggaggcgacccacaaacgcctgaccacattgatgcgccacgaacacgcgccgctggcactggcccagcgttgcagcggcgtggtcgcgcccacgccgttgttcagtgccttgctcaattaccgtcacagccacacggcggcgaccgcgagtgccgagaccctggctgcctgggaaggcatcagcacgatcagctccgaagaacgcaccaactacccactgaccctgagcgtcgatgatttcggcgatgcgttcagcctgacattactggccactaccgaggtcgaaccacagcgcctctgcggttacctgcactgcgccctggaaagtctggtactcgcgctggaacaggcgccggacaccgcgctcaatcaactgccgattctgccggcagcagagcgcgagcaggtgctgcgggcattcaatgccagccacgccgacttcccggcaacgttgaccattgcccaacgcttcgaggcgcaagtggcgcagcggccggaagccgtggccgcgcaatacctcggtgagcaactgagctatgccgaactcaaccggcatgccaacgcgctggcccatcatttgatcgcgctcggggtgaagcccgacgatcgcgtcgccatcgtcgcccgccgaggcctcgatacgctggtcgggctggtggcgattctcaaggcgggcgccggttatgtgccggtcgacccggcgcacccggccgagcgtctgcactatttgctcagcgatagcgcccctgtcgccgtgctgattcagaacactttgcgtgagcgtttgccggcgctgacggtgccggtgatcgatctcgacccgttgacctggccgctcagcgagacccttgacccgcaggtgccgggcctgaccgccgcccatctggcctacgtgatctacacctccggctccaccggcctgcccaaaggcgtgatggtcgaacaccgcaccttgtcgaatctggtcgattggcattgcagtgcgtttgatctgtgcgccggtcgccacacctcaagccttgccggcttcggtttcgacgccatggcctgggaagtctggccggcattgtgcgctggcgcgaccctgcacctggcaccgactcacgaaggcagcgaagacatcgatgcattgctcgactggtggcgcgcgcagccactggacgtgagttttctgccgacgcccgtggccgaatacgccttcagccagaacctcgaacacccgacgctgcgcacactgctgattggtggcgaccgcttgcgccagttcagccgcaaccagcagttcgacgtgatcaacaactacggcccgaccgaagccaccgtggtcgcgacctccgggcgaatcgaggcgggtgacgccttgcatatcggcaaaccggtaaccaatgccacggtgtacctgctcgatgaacagcagcgtccggtgccgattggcgtcatgggtgagttgtacgtgggaggcgccggggtcgcgcgtggttatttgaatcgcgccgagctgagcgccgaacgcttccttcatgacccgttcagcacttcgctgaatgcgcgcatgtatcgcaccggcgacctcgcacgctggcgcgccgacggcacgattgactacctggggcgtaacgacgatcaggtgaaaatccgcggcgtacgcatcgagcttggcgaaatcgaaacccgcctcaatcagttgcccggcattcaggaagccgtgttgctggcgcgtgaagatgaaccgggccagccgcgactggtggcgtatttcaccgagcagagccaggtcgaaccgctggcggtggccgaactgcgcgcgcatctgttgacccagttgccggactacatggtgccggtggccttcgtccgcctcgacgcgttgccgttgaccgccaatggcaaggtcgaccgcaaggccctgccaaaacccgagcgcgcggcgttgtttacccgcgaatacgaagcaccgcacaacgagctggaaagcgccttggcgcagatctgggcgcaggtgctgcacgtcgagcgagtagggcgtcaggatcacttcttcgaacttggcggccattcactgttggcgatgcgcatggtgtcccaggttcgccagcgtctgggcgtggaactggcgctgagtgatctgtttgccaacgccgaactggcagcggtcgccgaggccgtggcacaggccgggcgcagcacgcaaccggagattgtcgcagtggcccgtgacggcgccttgccgctgtcgttcgctcagcaacgcttgtggtttctggcgcagatggaaggtgccaacaccgcgtacaacattcccatcggcctgcgtctgcgtggcagtctcaatgaacaagccctgcaacaggccttggcgcgcatcgtcgcgcggcatgaaaccctgcgcagccgtttcgcccagtacaacgatgcagcgcaagtgctaatcgccccggtcgacagcggtctgctgctgcgcattgaagacctgcgccagctcccgcaagccgacgagaccttagcggcgctgattcagggtgaagcctcggggccgttcgatttacaggacgatgcgctgattcgcggacggctggtgcggctggccgacgatcatcatgtgctgttgctgaccctccatcacatcatctccgatggctggtcgatgggggttttgacccgtgaactgatggcgttgtatcaggccttcagccacggccagcctgatccgctaccgccgctgacgctgcaatacagcgattacgcggtgtggcagcggcgctggctcagcggtgaggtgctgcagcgccaaagtgaatactggcaacagaccctggccggcgcgccggcgctgttgacgctgccgactgaccgcgtgcgcccggcgcagcaggattacgccggcagcaccgtcgatgtggtgctcgacgaacgcttgagtgccggtctcaaggctttggctcagcgtcacggcgtgaccatgtacatgctcatgctcagtgcctgggcgagtctgttgagtcgtttgtccgggcaatcggaagtggtcatcggttcgcccgtggccaaccgcacccgcgccgagatcgaaggtctgatcggcatgttcgtcaacactctggcgctgcgtattgatacgtcgggcgagttgagctgcgaagcgctgctggcgcgggtcaaggcgcggacattgcaagcgcaggcgcatcaggatctgccgttcgaacaagtggtggaaatcaccaagcctgcgcgcagcatggcgcacagtccgttgtttcaggtgatgttcagttgggacagcggccatggcgccagtctgagtctcggcgatctgaccctggaaagcgtcgccgaaccgagccacttcgccaagttcgatctgtcgctgacgctggcagacgcgccgggcgggattcgtggtgtgctggagtacgcgattgccctgttcgacgaagcaaccattgaacgttatgtcggctacttccagcgactgttgcaggccatggtcagtaacgatcaagcggtgctggagcaggtggcattgttggacgacgacgagcgtcagcgtctgctggtggatctgaacgcaaccgccgtcatccacgatcttgagcagaccgttcacggccgcttcgaagcgcaggtcttgcgcacgcctgacgctgacgcggtggtggccggtgagcagcgtttgagctatgccgagttgaaccgccgcgccaaccgcctcgcgcatcacttgcgccagtgcggcgtgggctgcgattcgcgggtggcaatctgcgtcgagcgcgggcctgagctgctggtcggtctgctggcgattctcaaggccggcggcgcttatgtgccgctggacccgggatatcccgccgagcgtctggcttacatgctcgaggacagcgcgcccgtggcggtgctggtgcatgcaccgacgcgtgcgctgatcggcgagtgggccggcgtgttggtcgatttcgaccagtgcacctggcaagaccttgcgcaaagcaatccgcaggtgccggacctcagcgctgcgaacctggcttacgtgatttacacctcgggctccaccggcaccccgaaaggcgtgatggtcgagcaccgcaacctgggcaatttgctgcactggagcgccagcctgtgtccgctggcgaccggcgctgcgctgttgcagaaaaccccgttgagtttcgatgcttccgtctgggagctgttctggccgttgacctgcggcatgcgcctggtcctcgccggcccggacgatcatcgtgatcccgccgcgctggtgcagctgattcgtcagcaacaaatcaatgtcatccagttcgtaccggcgctgttgcagcaattccttgaagtggaagaggtcggcgagtgccgtagccttagcgatgtgttctgcggcggcggtgagctgactggtgcgttggtgcgcagcgtccgcgagcgtctgccgcaggtgcgcctgcacaacgtttatggcccgaccgaagccaccgtcgacagcacggtgtggacgctggagcctgattcgccggttctggaaagcacgccgccgattggtaaaccgttgtgcaatacccgcgtgtatgtcctcgacgctcatcagcaaccggtgccattcggcgtggtcggcgagatctatctgggcggtgtgcaggtggcgcggggctatctgaatcgacctgagctgacggccgaacgcttcctcgacgatccgttgagcgatcagccaggcgcgcgtttgtaccgcaccggcgacgtcgcacggtatctggccgatggcaacatcgagtacctggggcgcaatgacgatcaggtcaagatccgtggtttgcgcatcgaactgggcgagattcaggcacatctggcgcacatcgacggcgtgcgtgaagcggcggtgctggcccgtgaagacgtgccgggtgatcagcgcctgatcgcgtactacagcggcgagccgttggacatcgatcaactgcgcagcgaactgctcaagcacttgccggactacatggtgcctgccgtgtttgtgcatctgccggccttgccactgagtcccaacggcaaactggatcgccaggccttgccggcccctgacccgtcggcgctgctgacccgcgcctacgaagccccgctcggtgaagtcgaaaccgtcattgccggtatctgggccgaggtgctgaaggtcgaacgggtagggcgctttgatcactttttcgagctgggcggccattcgttgctggcggtcaatctggtcgcgcgcatgcgccgcgccggcctgtcggcggatattcgcgtgctgttcggccaaccgacgctggccgcattggcagcggccgtgggcggggagcctgaagcggcggtgccggcaaatcttgttccggcgggttgcgcgcgcatcacgcctgatttgctgccactggtggcgctggatcaagcgaccatcgaccgagtcgtcgcgagtgtccccggcggcgcgcgcaacgtgcaggatatctacccgctggcgccgctgcagacgggcatcctgttccatcatttgtcgtccgctcaaggtgatccgtatgtgctgcaagcgcagtttgccttcgccgatgaacagcgattgcaggcctttactgtcgccctgcaacgggtgattgaacggcatgacattctgcgcacgtcgctgttctgggaaggccttgaagagccggtgcaagtggtctggcgtcaggcttcgctgagctgcgaggccttggcgctggatgccgaagcgggcgatgtgctaagccagttgcgtggccgattcaccatcgataactatcgcatgccggtcgccgaggcaccgctgatgcgcgtggtgtacagccgtgatgtgtccaatcagcgtgtggtggcgttgttgctgttccatcatctggtgatggatcacgtggcgctggaggtgttgcagtacgaaatgcaggcgtttctgctgggcaacgccgggcaactgagcgagccggtgccgtatcgcaattacgtggcgcacacccaggccggtctgagtgagcaagagcaccaaagcttcttccgcgaaatgctcggcgcaatcgatgaaccgaccttgccctacggtcaaaatcttgcccatgacggtcccgcgcaagaagcgcagttgacgctggaaaacacactcagccacagcgtccggcagcaggcacggcgattgggtgtcagtgctgccagcctgatgcacctcgcctgggcgcaggtgctggggcagctgtccgggcgcgatgccgtggtgtttggcacggtgttgctcggccgattgcagggcggtgagggatcagagcgcgcgctgggtgtgttcatcaacaccttgccgctgtgcatcgagctgaacgctcacagcgtcaaaggcgccgcactggcgactcatgaacgcttgagtcagttgctggcccatgaacatgcgcaactggcgcaggtgcagcaatgcagcggcatgccgacgggcacgccgctgttcagcacgctacttaattatcgtcatagtgccccggtcgggccgatatctgccgaggtgcaagcggcgtggcacggcatgcaattgctcgatgccgaggaacacaccaactatcgcctgaccctcagcgttgacgacctcggcgaagacttccgcctgaaggtattggccggggccggcattgatgcgcagcgcatctgcgggtacatgcagggtgcgttaagcgcgttgcttgatgcgctagagcaaacgccgcatgtgggttttgatcggttgtcgatcctgccggcagcagagcgcgaacagttgctggtggatttcaatgcgaccgaagccgactacccgcgcgggctgacgattgcccagcgcttcgaatcgcaggtcgccgagcgtccgcaagcggtggcggcgatgtttgccgggcagccgctgacttacttgcagctcaatcgccaggccaatgcgttggcgcatcacttgatcgccatcggggtgaaagccgatgaccgcgtggccattgtcgcccgtcggggtctggacacactggtcgggctggtggccattctcaaggccggtgccggctatgtgccgatcgatccggcgcatcccggcgagcggatcagctatttgttgagtgacagcgcgccggttgcggtgctcacgcaaagcgatctgcacgagcgactgccggtgctgagcgtgccagtgatcgatgtcgacctgtgtgggtggccggcgcaggcgcagcacaaccctgcgctgccgaacttgagcgctgcgcacttggcgtacgtgatctacacctccggttcgacgggtctgcccaaaggggtcatggtcgagcatcagacgctgtccaacctgatcgactggcactgtgaagcgttcgacttgcacgccggcagccacacctcaagccttgccgggtttgggttcgatgcgatggcgtgggaagtctggccggccctgtgcgcgggtgcgaccttgcacctggcaccgactcatgacggtgctgaagacatcgatgcgttgctcgactggtggcgtgcgcagccgctggacgtgagctttttgccgaccccggtcgccgaatatgcattcagtcagaacctcgatcacccgaccttgcgtaccttgctgatcggtggcgatcgcttgcgtcagttcagccgtcagcagcgctttgctgtgatcaacaactacggcccgaccgaggccaccgtggtcgcgacttccgggcgtatcgacgtcggtgcggcgttgcacatcggccaaccggtggcgaacgcggcgatttacttgctcgatgagcagcaacgcccggtgccaatgggcgtgatgggcgagttgtacgtcggtggcgcgggcgtggcgcggggttatctgaaccgtgctgatctgaccgccgaacgcttcctgcgcgacccgttcagccgcacgccgaatgcgcgcatgtaccgcaccggtgaccttgcccgctggcgcgaagacggctcgctcgactacttgggacgtaacgacgaccaagtgaaaatccgtggcatgcgcattgaattgggtgaaatcgagacccgcctcaatcagctcaccgggatcaacgaagcagtgctgctggcccgcgaggacctacccggtcagccgcgactggtggcgtatttcaccgagcaggccgagatcgaaccgctggcggtgagccaattgcgcgcacagctgttgacgcagttgccggactacatggtgccgacggcgtttgtccggctcgaggctttgccgctgaccgccaatggcaaggtcgaccgcaaggcgttgccgaaaccggatctggccgcactgcccacccgcgaatacgtggtgccgcaaggcgagctggaaactgcactggcgcagatctgggccgaagtgctgcaagtcggacaggtcggccgtcacgatcacttcttcgaactcggtggccattcgctgttggcgatgcgcatggtctcgctgatccgtcagcgcctcggcgtcgaactggcgttgagtgagctgtttgccgacgcgcaattgagcgcagtcgccgaagtattgaaccgtgccgggcgcagtacgttcccggacattgtgccggcaccgcgtgatcaagcgctgccgatgtccttcgcccaacaacgcctgtggttcctggcgcagatggccggtggcaactcggcgtacaacatccctgtcgccttgcgcttgcgcggtcacctcgacgtcgatgccttgcaaaaggcgctggcgcagatcgtggcccgtcacgaaaccctgcgcagccgtttcatccccgtcgacgacaccgcgcaggtgtcgattgccccggtcgacagcggtttgctcttgcgcgttgaagacctgtaccaagacttgcaggcagagcacaccttgcaggcattgatggcgcaggaaacctcgacagcgttcgatttgcagaacgactcgctgattcgcgggcggctggtgcgtctggccgacgagcatcatgtgctgctgttgaccgtgcatcacatcgttgccgacggctggtcgatgggcgtactgaccactgagttgatggcgttgtatcaagcgttccgccagggacagcctgacccgttgccagccctgaccctgcaatacggcgactacgccgtgtggcaacggcactggctcagcggtgaagtgctgcagcggcaaagccaatactggcagcagagcctcgatggcgcgccggccttgttgacgctgcccaccgatcgcccgcgaccggcgcaacaggattacaccggtgccaacctcgaagtgctgctggacccgcgcctgagtgcagggctcaaggccttgagccaacgtcatggcgtgaccctgttcatgaccgtgatgagcgcctgggcatcgctgatgagtcgcctgtccgggcaaaccgatgtggtgatcggtgcgccggtggccaaccgcagccgcgccgaagtcgaaggcttgatcggcatgttcgtcaacacgatggccttgcgtatagacacctcgggcgcaccgagtgtcgaaacactattggcgcaggtcaaggtgcgaacactggaggcgcaagcacatcaggatctgccgttcgaacaagtggtggaaatcacccgaccgctgcgcagcctggcgcatagcccgttgttccagaccacgttgaactgggacagcagcgtcggtccgcaattggcgttgggcgagctgacacttgagggcgtcgccggttcgggcgatgtcgccaagtttgatctgacgctgacactgggcgaggtcaacggtgtgattcgcggttcgctgaactacgccacggcgctgttcgatgcgtcgacggtcgagcggtacatcgggtacttgcagcgcttgcttgaagcgatgatcagcagtgatcaaacggtgttggagcaggtgccgttgctggcagcagatgagcgtcagcgcttgctgcgtgacttcaacgccacggcgcgcgattacccgcaaacactgaccgtgcacggtgttttccagcagcaggcagcggcgcatcccaaagcggtggcggcggtgcatggtgcgcattcgctgagctactttgagctgaatgcccaagccaaccgtttggcccatcacctgatcgctcacggcgtgcaaccgggcgaccacgtggcgatcctgctgccgcgttcgctggaactgctggtggcacaactggccattgccaagtgtgcggcggcgtacgtgccgctggacatcaatgcgccgagcgaacgccaggcgttcatggtcgaggactgtcaggcagtggcgctgctgaccttgagcagtgaaatcatcgcctacgccgcgccgcgcatcgatctcgacacgctgaccctcaacggccagccgacgcacaatccgaatcttgtgcagtcctccgaggcgctggcgtacatcatgtacacctccggttccaccggcacgccgaaaggggtgatggtgccgcaccggggcattgggcggttggtgctcaacaacggatacgccgatttcactgcgcaggatcgcgtggtgttcgcctcgaaccctgcgttcgatgcgagcaccatggacatctgggcgccgctgctcaacggcggtcgcgtggtggtcatcgaccatcaaaccctgcttgatccgaatgccttcggccgtgaactgagtgccagcggcgcgacgatcctgtttgtcaccaccgcgctgttcaaccagtacgtgcaactgattccgcaggcgctcaagggcctgcggattctgctgtgcggcggtgagcgtggcgatccggcggcgttccggcgactgctggccgaggccacggcattgcgcatcgtgcattgctacggcccgaccgaaaccaccacttacgcgacaacctttgaggtgcgcgaggtggcggaaaacgccgagagcgtgccgattggcggccccatcggcaacacgcaggtgtacgtgctcgacgcgtatcagcaaccggtgccgatgggtgtgacaggcgagctgtacatcggcgggcagggcgtggcgctgggttacctgaaccggccggatctgagcgccgagaaattcctccgcgatccgttcagcgaaacaccgggtgcgctgctctaccgcaccggcgacctcgcgcgctggctggcgccggggcaactcgactgcatcggccgcaacgacgatcaggtgaagatccgtggctttcgcatcgaactgggggaaatcgaaaaccgcctgctgaactgcccggggatcaaggaagcggtagtgctggcgcgccgcgacggtcaggacgccacgcgtctggtggcgtactacacggcgcacgatggcgtcttggacagcgccgaactgcacgcgcaattgcacgcacgactgccggaatacatggtgcccaccgcgtgggtgcaacttgatgtcttgccgttgaacaacaacggcaaggtcgaccgcaaggcactgccggcgccgacccaggaagcgctgctcagtcgggtttacgaggcaccggccaatgcactggaaacccgcctcgcacgggtctgggccgaggtgttgcaggtcgaacaggttggtcgccacgacaacttcttcgaactcggtggtcattcattgttggcgatgcgcatgctgtcccaggtgcgtcagcagttgggcgtggaactggcgctggccgatctgtttgccaacccggagctggcggcggtcgcccaggtcctgggtcaggccgaacgcagcaccttgcccgagattctgccggcaccgcgagatcaggcgctgccgctgtcgttcgcccagcaacgcttgtggttcctcgcacagatggacggcggcaacaccgcctacaacattcctctgggcttgcacctgcgtggccgactcgacgccgtggccctgcaacgggcattggcgcgaatcgttgcgcgccacgaaaccctgcgcagccgtttcgcgcaattgaacgacgaagcccaggtactgtttgccccggtcgacagtggtctgccgctgatcgagcaagattggcggcaacagccgcagaccgacgaggccttgcgcacattgctcgaaagggaagcgcgcgggccgttcaatttgcaggatgagccgctgattcgtggacgtctggtacgtctggccgatgatcaccatgtgctgttgctgacgatgcaccacatcatctccgacggctggtcgatgggcgtgctgacccgcgaactgatggcgctgtatcaggcgttcagccgtggcgaggaggatccgctgccgccgctgaccctgcaatacgccgactacgcggtgtggcaacggcgctggctgagcggtgaggtgttgcagcgtcaaagcgattactggcagcagacactggccggtgcgccggcgttgctgagcctgccgactgaccgtccgcgtccggcgcaacaggatcaccacggcggcagtgtcgaaatcgtgctggacgagcagaccagcgccggtctcaagtcgttgtgtcagcgtcacgccgcgacgccgtacatggtcatcatgagtgcctgggcgatgttgctggcgcgcctgtccggacaggccgatgtggtggtcggctcgccggtggccaaccgcactcgcgccgagatcgaggggctgatcggcatgttcgtcaacacgctggctctgcgtatcgatacctcgggcgatctgacgggcgcagcgctgctggcgcgggtcaaggcgcagactttggcggcgcaggcgcatcaggatctgccgttcgaacatgtggtggaaatcactcgaccgttacgcagcctttctcatacaccgttgttccagactctgctgagctgggacagcagcgttgcgcccgctttggcactgggcggcctgacgctggaaggcatcgctggggaaaatcacttcgtgaagttcgacctgtcgttgagcctcggtgaaactctgcaaggggttcgcggctcgttgcgctatgcgacggcgttgttcgatgagtcgacggtgcggcgttttgtcggttacttccagcgtttgctggcggcgttggtcagtgatgatcaggctgtgttggcgcaagccgggctgctggcggcggatgagcagcaacgcctgctcggcgaattcaatgcgacggcggttgattgcccggtcgaggagccgattcagagcctgttcgaagcgcaggtgcagcgtcagccggatgccattaccgtgcagatcggcgaacacagcctgacttatcgcgaactgaatgcccgcgccaaccgtcttgcgcatcatctgcgcgagcagggtgtggggccggatgcgcgggtggcgctgtgcgtcgagcgtggactcgatctggtggtggggttgctcggcattctcaaggccggtggcgcttatgtgccgctggatccggcttatccggcggagcgcctggactttatgctcagggactgcgcgccgacggcggtattagtacacacggcgacccgatcgctgttctccgcgaccgatgcgctgctgatcgactttgatcaatgcagctggcacgaccaggcagacagcaatccgcaggtgcccggtctgaatgcttcgaatctggcttacatgatctacacctcgggttcgaccggcacaccaaaaggcgtgatgcttgaacaccgtggcctgtgcaatctggtgtattggggctcgcagatctgcccgccgaccacagacggcgcgctgttgcagaaagcgcctttcagtttcgacgggtcggtgtgggagttcttctggccgctgacggcgggtgtgcgtctggtattggcacggccgggcggtcaccgggaaccggcgtatctggcgcaagtcattcgtcagcaacgcattacggtggtcaagtttgtgccggcgttgttgcagcagtttgttgaactgcaggacgtcagtgaatgcaccagcctcaccgatgtgttctgtggtggcggcgaactcacggcggcactggccgctgctgtgcgccagcacctgccgtgggtgcgcctgcataacgtgtatggcccgaccgaggccacggtcgacagcacggcgtggacgctggaaccgcacatgccggtgccattatctgaattgccaatcggcaaggctatctgtaacacccgactgtatgtgctcgatgcgcacgatcaagctgtgccgcacggcgttattggccagttgcacattggcggtatcggcgtggcacgcggttacaggggactgccgcagatgcaggccgagcgctttatcgacagcccgttcgtagccggtgatcgcttgtaccgcaccggcgatctagtgcgttaccgcgccgacggtaacctcgaattcctcgggcgtaacgacttccaggtcaagctgcacggcttgcgtctggaactcggtgaaatcgaagcgcggttgattcagcacccacaggtgcgcgaggtggtggtgctgatgcgcgacgagcgactggtcgcgtatttcactgcggttgatcgccgtgctgtgccggcgatcgatacgctgcgcgcgttcgtcctcgagcagttgcccgaatacatggtgccgggcgcatttgttgcgctcgacgtcttgccgctgagtcccaacggcaagatcgaccgccaggcgctgccggcaccaggcctcgacgccgtgctcagccggcactacgaagcgcctcaaggtgaggtcgaaaccttgctggcgcgggtctggagtgaggtgctgaatgtcgagcaggttggacgtcacgacaacttcttcgaattgggcgggcattcattgctggcgattcgtctggtcaacgtgctgcagcggacggggcaacaagtgacgctggcggagctgttccagcggccgagcatcgaggcgctggccgcgctgctcagtcagcgcagtggtgtgctcgatcagccggaaggactggtcgtggtgcgaccgggcgagggcggcaatgcgctgttcctgatccatgaattcagcggtcgggatgtgtatttcccggcattggggatgcacatcgaggggcagtttccgatttacggtttgcccggtgtgccgttggggcagccgcaactgcgcacccttgaatgcatggcggcgcggatggtcgggatcatgcgctcggtgcagccgcacgggccttaccgtctggccgggtggtcgtttggtggcttgctggcctatgaaatcgcacagcaattgctcggtctcgacgaggcggtggcgtttgtcggcctgctcgatacctacgccccgcactcggccagccaggataaaacccgctggagcggcgagcatcgtgacaagcgtcaattgctcgaacattgtcgggcgcgttcgcagatgctgggtgaacaagggctgcaagcgttggctgatgtcgaaaggcttgaggctgaagtcgaactcattgcgttcgatgaactgttccagcgctgctgcgaacagcaattgcctgacccggaactggccgcactgacggcggcgcaggcctggagttacttcgatcgtgaggccgctcatggcctggcgctggcgcattatcgggtcagcccggccagccaaccggtgcacttgttccgcgctcagtcactgatgccggggcaggcacagccgagtccgacccgtggttgggagaacaaggtcggcagcggtttgctgcgctgcatcgatgtgccgggggatcaccgcagcatgatgaaaaaaccggatatccaggcactcggccaggccttgagtcaggccatggccgctgcgcaggccccgcaaccacaggcttatcaacccatgttgacgatccagagcgggcacgccgggcatgcgccgatcttctgcgtgccgggggcgggcgacagtgtcaccgggttcattcacctgaccgaagcactgggcccggaatggccgattttcggtctgcaaccgcgcgggctcgatggcagtggcgtgccgcacagttcggtggaagcggcggcgaagtgttatctgcacgccgtcgaacagctgtgtccgcaaggcccggtgcacctgatcggccattcgttcggcggctgggtcgcgcatgccatggcggcgcagttgcaggcgacggggcgtgaagtggcgtccttgaccctgattgacagcgaagcacccggtggcaacggcacggcgggcaaaccgtatacgacgaccgccgcgctggagcgtttgatcgagacgttgcaactgtccagcggcaagtcgttgggcatcgatccgctggtgttcgccgaggctgacgacgctacgcaaatgtccctgctgcacgagggcatggtgcgcgccggtgtgttgtctgcgcgttcgtcagcgcaggcgatgcacggcccggtacgcacttttgccacggcactgcgcacggtctatcaaccgcaactggcctacaccggcccagtgcggctggcgctggtcgatgacccgacgctggattcgtggggcaatcagcgcgagcaggcggcgatggttgaagggtggcagcgccaggtcgcggatctggtggtgtggtacgggccgggcaaccatttcacgattctcaaggcgcccaacgtcttcagtttcgcagcgtggtggcatgacggccggaaagtgccagcgggcgaaatattgtcctgattgttgtttatctagcagagcccggcgtcacgccgggctcgatcctgaacggacttgtgggcatttatggaaaagtcgaagtggcgcaaagccggtatgggtttggcgttggcggtggtggcgggtttggtgttctacacggtgcaggcaccggccgaggcgccgcagtacctgaccgccacggtcgagcgcgatgacattgagaacgcagtgctggccaccggcgtgctcgaagggatcaagcaggttgatgtcggtgcgcaggtctctggccaactgaagtcgctgaaggtcaaggtcggcgacaaggtgaagaaggggcagtggctggcggagatcgatccgctggtgctgcagaacaccctgcgtcaggctcaggtcgatgaggaaaacctgcaagcgcaaaaacgcgccacgcaggcccaactgaaacagaccaaggcgatttacgagcgctatcagaacctgcaggaagatgcgtcgatttcgcgccaggatttcgaaaccgccgaatccaactatcaggtgcagcaggccaatctgatgtcgctggatgcgcagatcaaaagcgcgcacatccagatcgacacggccaaggtcaatctggcgtacacgcggattgtcgcgccgatcgatggtgacgtggtcggcgtggtcactcaggaaggccagacagtgattgccagccaactggcgccggtcctgctgaaactggcggacctggacaccatgacggtcaaggcgcaggtctccgaagccgatgtaatccatatcgcgccggggcaagaggtgtatttcaccattcttggcgaggacacacgctactacgcgaaattgcgcggtaccgatccagcgccgcagaattttctcgaaaccccgcccgccggcacgccgaagcaaagcagcgcggtgttctacaacgctttgtttgaagtgccgaaccccgaccatcgcctgcgcatttcgatgaccgcgcaggtgcgcatcgtcctcgacaccgccaaggcagtgctgaccgtgccggtggcggcgctcggcccgcgcaatgccgatggcagctttccggtgcgggtgctggatgccaagggccacgcgcagtcgcgcaatgtgcagaccgggatcaacaacaacgtcaaagtgcagatcaatgatggtctggctgaaggtgatcgcgtggtcatcggtgatccgctgaccaatgtggcgggggcctgagcatgaccgagccactgttacagctgaccggcatcacccgcagtttcactgccggcgaccgcgaatttctcgcgctgaagaacatcgacctgacgatccatgccggggaaatggtcgcgatcatcggcgcctcgggctccggcaaatcaacgctgatgaacatcctcggttgcctcgattacgccaccgccggcagctacaagatcaacggccaggaaacccgtgatctggacaatcaggcactcgccgaactgcgtcgtgactacttcggtttcatcttccagcgttaccacttgctgccgcatttgagcgcgatgcacaacgtcgagatgccggcgatttatgccggcacgccacagctgcaacgccatgcccgggcccgagagctgttggcgcgactgggcctcgaaggccacttgacgcatcgaccgagccagttgtctggcggccaacagcagcgggtcagtatcgcccgggcgttgatgaacggcggcgaagtgatcctcgccgatgaacccaccggcgccctcgacacggccagcggcaaggaggtgatgcgcatcctcctggagctgcacgcggcggggcacacggtgattctggtgacccacgatccgaaagtcgcggccaacgccgaacgcatcatcgaagtcagcgacggtgaaatcctcagcgaccgcgccaacgaacgcgacaccacgcacctgctcagcgatgagccagtggcgccgagagccaccgcttcacggcgtctggtggccagccttggcctgttcaaggaagcgttcagcatggcctgggtcgcattgatctcgcaccgcatgcgcaccttgctgaccatgctcgggatcgtcatcggcatcacctcggtggtgtcgatttcggcggtcggcgagggcgccaagaactacgtgctcaaggacatcgccgcgattggcagcaacaccatcgatgtctatcccggcaccagctacggtgacaagcgtgcggcggccatcgaaaccctgacgccggccgatgtcacggcactgaatcagttgtactacgtcgacagcgccacgccgatgattggccgcagcctgttgttgcgctaccgcaatatcgatctggatgcgcaggtcaacggcgtcagcgatcagtacttcaaggtgcgcggcatcaagatggcggcgggtattgcattcagcgaaagcgatgcgcggcgccaggcgcaagtggtggtcatcgatcacaacacccggcaacgcttgttcgggcaggatgtcgatccgttgggccaggtgatcctgatcggtaacctgccgtgcacggtgatcggcgtcgccgcacaggataaaagcctgtttgcctcgggcaagaccctcaacgtctgggtgccctatgaaaccgctgcggggcgggtgttgggccagcgttatctggacagcatcagcgtgcgcatgaaggacggccagccgagcaaagtggtggaagagcatgtgacccaactgctgctgcaacgccatggcagtaaggatttcttcaccaacaacctcgacagcgttttgcagaccgtgcagaaaaccagtcgttcgctggcgttgttgctgtcgctgattgcggtgatttccttggtggtcggcggcatcggagtgatgaacatcatgctggtgtcggtgaccgaacgcacccgcgagatcggtattcgcatggcggtcggcgcgcgacagtcggacattcgtcagcagtttttggtggaggcggtaatggtctgcctgttgggcggggcgatcgggatttccctgtcgtacgcgatcgggcatctgttttcgctgtttatcaaggagtgggagatggtcttctcgttgacctcggtgctcacggcggtgatctgttcgacattgatcggcatcgtctttggcttcgtcccggcccgcaacgcctcgcgcctcgacccgatcgaagcgctcgcccgcgactgacagcccgcgcttgttgatcgttcccacgctccgcgtgggaatgcctttagggacgctctgcgtccagtgacgcgaagcgtcacgggctgcattcccacgcagagcgtgggaacgatcaacagcggcgttatcgaacagcggttctgcagtgttatcaggcagcgctcgatgccgaggtttcctgtggcgaatacatccagcgcatcaacgaatgccggccactgatgcccagcttgatcgccgcccgtttgagatagctctccaccgtgttgaccttcagttgcaattgctcggccagttccggtgccgtgtgcccggcaagcaggccgatgcacacctcggtttcacggttcgacaggctcaggcccaattgctgcaaacgttcggtgaagcgcaagcgcagggtttgcagcccggtgccctcgggggcttcgctggggctttcggcttcagggcaggcgggttgcacggcgttgatatgtttctcgaccatcggcagcagcactggggagatgtcttgcaacaggctgcgctcccgggcggaaaaacgttgcgactgaccgttgcggtacaccgaaatcacgtagcgaaaaccgtccttgcgtcgggtcaggtgcaattgcgaggcatcggtgacgttggctgattctgccggcggcagctcgtcgctgggcatcgcgctgtgttccgagaacagcgtttcggccagcagtgctggctctttcagcggttcggggccgttgcgaagggatgtacggcttaccgactcgacacgcatctggcggatgtgcgtggcgtccaccgccagttgagtgaggatcaggtcgtgaagcatgcgcggaaaatgccggctgccggtgctggcaattactttgccaatctgcgggaacagctgtgagttcatgtcattcatccatgagttgcaatgggcggctcgtgtcccgcaggcgccgggggtgaagctccttgaccggtgaaaacgcctcgggaactggatcctatcctagtacaacgtttcagcgaccgcttaatgaaggtgttattagttcataaccgacgcacacctcgccttgccgacggccgtttacttgcgcaacgccaggtaggatttgcccagatcgccggcccagccgtccagcacgatcttgacgtcatcggcgctcagcacttgtttgtcgttctccagcggcacgccgatacccttgcggaccacttcggcaaccacctcacccgtcgaaccatcctcgaacgacacttccgtggcgacttcgctgtcctggtcgcgaatgccggtggcggtgctcacgcctgctgcgaccagcgtgaccggcagccattcataaaagcgcaaaccctgggtgcgggtcgcgacccgggtaatcgccggtcgcacgatgagggtgtcgggccccggtgtcgacaccaggcgcatgactttgcccagttcctgtctgagcgccgcgtcatagtattcggtcacgccggacaacgtgctcagcggaatccgctcggtcggtgcgacgctcgggtagaactggctgggcgccagataggcctgggtataacggcctcgggccaatgccgggctgacccatccgagtaccgtctgccccgacggtgactggcgttcgctcaacaggctgtagtcatgcagaaatccactgtacatcttcggttcgacggttttattgctgcatgccggcaggctcaaggtggcagaaagcaccagcgacttcgagaaattgctgatcatcaatggctttccttgtgggctggcggggcgttgtccgagcactcgatatgcaactggccgtggcgcatgatccagtgcacgaggtcggcgactggaatcgaatgcacgtattccacccagtgcgcgttgtccgggctgaattgttcgaagtagcggcgcaggacgatgcgctcctgattgccggtcaggcccaggcacgactcctgaaacagaatcggcgtatcgtgcccgggagccgtagtgcgctggctaaggatcaacggacgatggctggcgcggcacttggcggtgtacctctgattgaattccttcatgggagccccctgcgatgaaagtcccgcagagtgcccgaggaggattgcccgggaatgtccgattgttgtcggcgcggaaggaatgttgcgtgattgaaataaatgacccgaacggcgaaatggttttagatgcgctcttttttggcccttggatcctgtgaccgtgagcagattgctgatcgtcgatgacgacatggaagtgctgtccctgctgaagaagttcttcgttcagcatgcctacgaggtcgatgtcgcgcccgatggcgtggcgatgtgggcggccatcgcgcagcagcgcccggacaccattattctcgacgtcatgctgcccggcgaaggcggcctgagcctgtgccagaaaatccgcgcacagatgggcattccgatcatcatgctcacggccatggccgagctcagcgatcgcatcgtcggcctggagcttggcgccgacgattacctgaccaagcctttcgcaccacgcgaattgctcgcccgggtgcgcgccgtgcagcgtcgtgccggcgagcagccaagtcccgccagtgaacgcccgcgaccggtgattgcgttcgccggttggcacctggatatcacctgtcgcgagttgcgctcgccggagcaggtgatgattccgctgtccgctggcgaattcgacctgttggtggtgtttctcgatcatccccagcgcattctcacccgcgaacaattgatcgacctgacgcgtggcgaaggccacgacgcctttgatcgcagcatcgatgtccaggtcagtcgcctgcgacgcaagatcgaacccgacagcaagcgtccagacctgatccgcactgtgcgcaacggaggctacatgttcaccgccaaggtcagccgttcgtgatccgccgtctgttgcgccgcgataccctgcgacggcggattgccctgaccatcctcgcggcgatgctggcttcactggcactcaatgccttgttcgtccaggtcgccggcatctgggcgcgcccgcccattgaacgcaccggcctgctcgaacagattgccgtgaccacgcggctgatcgaagccgccccgacgtcgctgcgtccgcaactggccagcgcggcaaccagttcgatgctgaacgtggtctggcatgctcggcgcgccgacttcgatctgcctgcgatcggcacgccaatcgaggcgggcagggggccggtgatgcaacaactgctgggtgacgaccgtgaaatcgaagtgttcagccccgatgactttccgcgcgacagcccgcgcgcgcactacgtcgcgctggtgcaattggtcgatggcagctggttgtcgtttaccccgccgcaacgcagttggggcctcgacgtcggcacgcggatcgcggtggtcatcgccctcggattgatcgccaccttgctggtggcatggctcgccacgcgccagttggccactccgctgcagcgcttcgccagcgccgcccggcgctttggcagcgatctgcgggcgccgccgatcaacgtcgaaggcccggacgaaatacgtcaggcaatcatcgccttcaacaccatgcaggcgcagatccagcatttcatcgccgagcgcacgcacatgctcgcggccatctcccacgatctgcgcgcgccgctgacccgcatgcgcttgcgcagcgagttcatggaagacctcgatcatcagcacaagctgatccgtgacgttgaagaaatgcagtcgatgatcaacgccgcgctggcgttctttcgtgaggacactcaccgcgagcagcccaccgcgttcgacctgtcggagttgctgcaaaccatcatcgacgattaccgcgaccagcacctcgctgtcgacttcagtggccccgcgcatctggtgtatgaggggcggccgctgggcatcaagcgggtgatcgtcaatttgctggaaaacgccgccaaatacgcgcagcaaccgagcatcgcactgagcggtaacgaccatacgatctgcatcgaggtgtgcgaccaagggccggggattcccgagtcggcgctgcagcgggttttcgatccgttctatcgccttgaagcttcgcgcaatcgtgataccggcggcgtcgggctggggctttcggccgcgcaggcgatcgtgcgcgagcagggtggtgagctgaccctgcgcaatcgcagcggcggtggcctggtggcgcgggtcgagctgcctcgggacctgttcgactgagaccatcagcgaccacgctgcggtttaccgtcatttccaacagctgatgagggaccgctgcagggacttcgacctgcaacccttgcgcctgcttgcggacagttttttgtcggcagtcgcgaagccgtcgagccgttctacgaataaccttgcagcgcgaggacggcagccttggcaatctgcgcgtcctgagcggatttgaccccggacacgcccaccgcaccgatcacttgtccgtcgacaatgatcggcacgccaccttcaagcgaggtcagcagcggcgccgagagaaacgcgttgcgaccgttgttgaccatctcttcatagacagtcgattcgcggcgaccgagggctgaagtacgggccttttccatgcagatgtaggcgccgatcggtgcacaaccgtcgaggcgctcaagcgccagcaagtggccgccatcatcgaccacggcaatactcaccgaccattggttgcgctgcgcctcggtgcgcccggcggcgaggatcagcgcgacttctctctggctcaatacgaatttgctgttcatggtttttcctgcgcgagaagggactcttcaagcacctcgatccagtgcctgaccggtgtgcggccagcgctgtcgaggtgaatctggcaaccaatgttggcggtgacgatgaggctgggcgaggcgctttccagcgcattgatcctgttatcgcgcaattgccgggaaagtgcaggttgggtgatcgaataggtaccggcggaaccgcagcacaggtgactgtcgggcactggcgtgaggtgaaaccccagccgtgtcagaacactttccaccgcgccaccgagtctgagcgcgtgctgaagcgtgcacggacaatgaaacgccagacgctgatcgttgtgcgccacgaccagttgttccagcggttccgcctgcagaatctccaccagatccttgctgatcgcactgattttggcggctttcattgcgtaggccggatcgtgttcgagcaggtgagcgtagtccttgatgaaggcgccacaaccgctggcggtttgcacgatcgcctcggcgccgcttgcgatcgccggccaccacgcatcgatattgcgccgcgcgcgctgcagtccggcctgttgggcgtcgaggtgatagtcaattgcaccgcagcaaccggcctcgctgatcggcaggatgctgatgcccagacggtcgagcacccgcgcggtcgcggcgttggtgttcggcgacaggctggtctgtacgcagccttcgagcatcagcatcgtgcgggcccgcgttcgcgctggtctgggtctggccggcgcaatgtgtcgcggcagcttcatttgcacagcctgcggcagcagtggacgcagtcgttcaccgaggatcagcaacggtttgaacaaccgcggctcagtcaacacgctgcgcaaaccctggcgcaacagacgctggccgggactgcgcggcgctgcatcatcgaccaccgcacggccgatatcgagcaggttgtgatagtcgacaccggatgggcaggtggtctcgcaattacggcaggacaggcagcggtcgagatgctgttgggtggtggcgcttgcggtattgccttcaagcacttgcttgatcaggtaaatccggccgcgtgggccatccagttcatcgccgagcagttgataggtcgggcaggtggcgttgcagaacccgcaatgcacgcaactgcgcaaaatgcgctcggcttctgcggcgcgcgtaaggcgcagggatttttcgctcagggtggtttgcatgatcagatctctgcgtacattcggcccgggttgaaaatcccttgcgggtccagttgcgtcttcagtgattgctgatagcgcagtaacgccggtgcgagcggctggaacggttgtgcgcagtttgcatggcagctggcgtgaccgctcgcctgggtggcgatggcgcggatggtcagggcgtcggcgtcggacttcagccagcgctgggctccgccccaatcgatcagttgttcgccgggcaggctcaacgggcctgtgtgcggcggcactgacaggcgccagagcggccttggatcggcaaaaaaggccaggcgctgagcattcagatcggcccagtacgccgtgtccagcggttcacccccgagtcggtcatgagccgccgtcaccgatccttcaccgccttccaggcgcagatgcaggcgttgcccgtcgtggctggcggcgctgatcggaaccggttgttggccccattcggcgagtttgagcaacgcacgctcgcggctgatttccagggcaatgctcaggctgtgacgtggtttcggcaggactttcagcgagacttcagtgagcaatcccaggcaaccaaaactgccagccatcaggcgcgagacatcgtagccggcaacgttcttcatcacttcgccgccaaaacgcagatgtttgccgtggccggtaatgatccgcgtgcccagtacgtaatcgcgcacggatccggcccaggggcggcgcggcccggacagcccggcagcgagcatgccaccgacggtggcacccgcctcactgtgtggcggctcgcatggcagcatttgtccggccgcgtcgagggccgcgttgagttcggccaatggcgtgccggcgcgtgcggtgatcaccagttccgtcgggtcgtagctgacaatgccgcgatgcacgcgagtatcgagcaacgcgccgtgggtcatgcggcccagatgggccttgctgttgccgccctggatgcgcaacgcaagtttgtcatgtagcgcctgctcaacctgttgcagcagttcggcggcggcgtcgttgtcatgttcgaccgtcatcagaaacgctccagatcggggaagggcaactggccgtggtggacatgcatcgcaccgaattcggcgcagcggtgcagggtcggaatatttttcccgggattgagcaggccgccggggtcgaatgctgctttgacggcatggaacagagtcaattcatcactgctgaactgcgcgcacatctggttgattttctcgcggccgacaccgtgttcgccggtgatgctgccgccgaccttgacgcacaactcaaggatcttgccgcccagggcttccgcgcgatccagctcgccgggctggttggcatcaaacagaatcagcggatgcatgttgccgtcgcccgcatgaaagacgttggccacgcgcaaatcgtactcgatggacaaatcggcaatagcctgaagcacgccgggcaattcgcggcgcgggatggtgccatccatgcagtaataatccggcgacagccggccgacggcagggaaggcattcttgcgtccggcccagaaacgcacgcgctcggcctcgtctttggcctggcgcagttcggtggcaccggcatgttgcagcacctgacgcacgcgctggcagtcgtcgtcgacatcggcttcgacgccgtccagttcgcacagcaggatcgcttcggcatcgatcgggtaaccggcgtggataaaatcctcggcagcacggatggcgaggttgtccatcatctccaggccgcccggaatgatcccggcggcgatgatgtcagcaaccgcgcgcccggctttttccaccgagtcgaacgccgcgagcaggactttcgcggtttgtggtttgggcagcagtttgacggtgacttcggtgatcaccccgagcatgccttcggagccggtgaacagtgcgagcagatcgaaaccgggtgagtccaatgcgtcggagccgagcgtcaggcactcaccctcgacagtgagcatctcgatcttgagcaggttgtgcacggtcagaccgtatttcaggcagtgcacgccaccggcgttttccgcgacattgccgccgatggagcaggcgatctgcgaagacggatccggcgcgtaatacaaaccatgcggtgcggccgcctgggaaatcgccaggttgcgcacgcccggctggacccgcgcaaaacgtccggcagggttgatttcgagtatccggttgaagcgcgccatcaccagcagcacgcctttttccagcggcagggcaccaccggacagaccggtaccggcgccgcgcggcaccactggcacgcgttgttgatgacagatcctgaggatggtagcgacttgttcgagctcgcgtggcagcaccaccagcatcggtgtggtgcggtaggccgacaaaccatcgcattcgtacggtttcagcgcctcttcactgtggaggatttccagctccggcatttgcgcccgcagcgcgctgagcagtgcgggtttatcggtggccggtaacacgccatcaacgcgttcgtcgtaaagaatattcatcgcgggcaggcaacccttggttattgtttttgacaggccgacgccacatgggcgtgcttgcatcattgggcgcacgggcaatactgtctacgtcgtccggtactggtcgaaccagttctttttgccgggtttttcgtatgaagccactcaagtcttttaaaacaacaagatgcgatgcaatcgctaagcagggagatgcagggttatggctggtcataccagtgaaggacggactgtgcaggtggcggatgtggtttgcgaacgtgtcgagcgattgatcgtcgacggcgtgttgaagaccgggcaactattgccctctgaacgccggttgacggaaaaactcggcgtctcgcgcaccgcgttgcgtgaaggcctgaaactgctccgcgcccgcgggatcatcagcaccaagcagggtaaaggctcatttgtcgccgacctttgcgggcagggcgtcgcatcgccgctgatgcacttgttcagctcgcaaccgcgcaccctgtacgacttgtttgaagtgcgcagcctgctggagggcgagtcggcgcggctggcggcgttgcgcggcaccgaagcggatttcgtcctgatcacccgcagctatcaggctttgctcgatgcgcatggctgtgagctgcaagcatccgaacatgcgcggctcgaccacgcattccatctggcgatctgcgaggcttcacacaacccggtgctggtgcagaccctgcgctcactgacggacttgttgctcaacacggtgttcgcttcggtcaacaatctctatcaccgcgaaccgcaaaaacgccagattgaccgccaacacgcgcgcctctacaacgccgtgaccgggcgcctgcctgaacaggcgcgcaaggctgctgtcgcgcatatccagagcatcagtgacaacctcaaggagatcgaaagcgaagagcagcggctggtgcgcgcgacgatgcgcctggagggctggacttgaatgtcgaatgattgtccgtttcaggttgacggtgaaacacattccagccgatttatcccgtccctgtgcgtcagtaatctgtacccaacttgaacgcaacaacaaattcaaaaactcaaaagggaagcagaccatgaccactccaacctacaaccgcctgaacaaagacgacgctatcgtgctgctggtcgaccaccagaccggcctgatttcgctggtgcaggacttctcgccgaacgaattcaagaacaacgtgctcgccctggctgatctggccaagttcttcgaactgccgaccatcctcaccaccagtttcgaacaaggcccgaacggcccactggtgccagagctgaaagagatgttcccggacgcgccgtacatcgctcgcccaggtcagatcaacgcctgggacaacgaagattttgtcaaagcgatcaaggcgaccggccgcaagcagatcatcattgccggtgtggtgacagacgtgtgcgtagcgttcccgaccttgtcggcgctggcagaaggctttgatgtgtttgtggtgactgatgcgtccggcaccttcaacaccaccgtgcaacaggctgcgtggagccgcatgactcaggccggcgcacagatgatgaactggttctcggtggcgtgtgagctgcaccgcgactggcgcaacgacattgaaggcttgggtaatctgttgtcgcagcggattcccaactaccgcaacctgatgaacagctactcggcgctgaccgcgcagcagaaataagcctcaagtgcgccaagcgaaaagcctgccctgaaaagcaggctttttcattgagttcgaatcagagtctcgacagcggcatggccgatagcgcgatgttcactcgaggggctgcgctctatacgctttatagagctgctggacttcaggattatcgaggtttgcataggtaatgccttccttgtccagcccatccaggcctttgatgccgccaatcatcccgggccattcgtctcgattggagatgtcgatgacgaagggcttcaaataactgtccagatggcctttaaacggattgcggatctcgtcactgagggcattgagatagtcgtccttgctggtttttgaccaatcgacggcgaaccgggtccgaaagcacaactccatgtagatgagcagtatggtgcggccattgccatccagaaacgggtgagcagaagccaattgtcccatcacctcgccgggccgatcgcggaagcgttttttatttgtcgccagttcaagggcgtattcgacggaccttttgatcaggtcggggcgttcgaatatcgtgtgctgaggatcatctttcgatcccttgaaaaccgccagatgagggacgagttcgttcctgtcttttcccgcccagggataaaaaccgcagaagaggatttcgtgtgtcttgaggacggcgttgtagtcgatggatcttttcttcgccagaaacgccagggcatcttcgatactggcttcgaaggaaaggtgttcggactcttttacttcaacggggtctttcagtttgagcgagttttgaagatagcctcagtctcgaaatcgccgaaggggtcgaaagtcacgagctaagctgctttttcaaacgccttttttcctgaagatagcggccttgcagcgctatgatttctgccttgttcagcacgccctttcttttcagattgaccagcagttgctcaacgccgtccagctcaacgatatcgcccgccaaacgtgtgatggtcaccgccatgcaactcaggctgtcacggtcagcgctgatcttgtgttctgcggcgagcttgcgaacttcgctcgcaacgctgtcagtggctgatctgttcatttgaaacccctcgttttctccttgaggagcatagcattcgtcgcttcggtaaatatttcggcgggcgcctctatgtgcgtatcgatcttgccactgtcctgttgaagttgacggtgaaacacattccagccgatttatcccttttcgatgggtcagtaatctgtacccaacttgaacgcaacaacaaactccaacttcgaaaagggacgcagaccatgaccactccaacctacaaccgcctgaacaaagacgacgctatcgtgctgctggtcgaccaccagaccggcctgatttccctggtgcaggacttctcgccgaacgaattcaagaacaacgtgctggccctggctgatctggccaagttcttcgaactgccaaccatcctcaccaccagtttcgaacaaggcccgaacggcccgttggtgccggagctgaaagagatgttcccggacgcgccgtacatcgctcgccctggccagatcaacgcctgggacaacgaagattttgtcaaagcgatcaaggcgaccggccgcaagcagatcatcattgccggtgtggtgacggatgtgtgcgtagcgttcccgaccttgtcggcgctggcggaagggtttgaggtgtttgtggtgactgatgcgtccggcaccttcaacaccacggtgcagcaggcagcatggagtcgcatgacccaggccggcgcacagatgatgaactggttctcggtggcgtgtgagctgcaccgcgactggcgcaacgacattgaaggcttgggtaatctgttgtcgcagcggattcccaactaccgcaacctgatgaacagctactcggcgctgaccgcgcagcagaaataagcctcaagtgcgccaagcgaaaagcctgccctgaaaagcaggctttttcattgagttcgaatcagagtctcgacagcggcatggccgatagcgcgatgttgggtttggtgtgtcttgagcacggtttgttgtcgatgggtctattctccgccagaaaggcctggacatcttcgatactggcttggaaggaaagatgttcggactcttttagttaaacggggtctttgagtttgagcgggttttgaaggcagttgccgaccgtccccgcggttaagctgtttaccgatgtgctgcgcgaaaccccgcgatagcattccgcatgcgttcagacccgatcaacctccggtcagcgatatcattcaatttgaaggactcgcactctgttgctgcgcgttcaacgcgctacttgtatccttgcgccggtcgaggacatacgaccgctgttattgccttgaatcagtaacggccggaacgggaaaccggactttccattaggtactttcgtgaagcgtgatacccacctcgtcatcctcttgctgctggtcatcggctgctctctggcgtccctgaccatctggaaagtgctgtcctcgcgcgatcgcgcgctggaggaagtcaacgtgcacgggttgaacctgacccaggcactcgagacctattcggagggcattgtccggcaaagttcgctgctgttgctcgggctggtcgaacgcctggaaaccgaaggcagtggccccgcgcagatccagcgcttgggtgcgttgatcaaccgccaacagccgttgatgccacaaatgagcgggatcaccatctatgaccgtcagggccattggctgatgtcgtcgaaccggccgattccggcgggggccaacagcagtgatcgggcctatttcattcatcatcgcgacaacccgagccgcgaaccctttatcgggccacccatccgtagccgctccaatcaggagtgggtgatcaccgtcagccgccgtttcaatgatgatcgcggcgagtttgccggggtcgtcgccgtgaccctgggcgtggaaaactttctgcgtctgttcggcaaactcgacatcggccaggagggcgccatcggcttgtcgtacaccgacggcacgttgctggtgcgctatccgttccgcgagcaggacatgggccgcaacttttccaagtcgccgatctacgccaagtacctggtcgatcaatcggtcggtaccgcgtcgtatacctccagcctggatggcgtcgaacgcctctacgccttccgcaaaagcgagaagttgccgctgatcaccaccgtcgccatcggcaaacgtgaagcgctcacggcgtggcgaaccgaggcgctgttgtcggcggtggtggtggcggggctgttgggactgaccggcctgatcggctggtgcttgatcctcgatatccggcgccggacccaggttgaaggcgaactgcgcattgctcagcagcagttgctcggctcgaaccgacaactggaactgctggccatgaaggatgcgctgaccggtctggcgaatcggcgctgcttcgaccagaccctggccacagaggcgcggcgggcacagcgcgacggctcatcgctggccttgctgatgatcgatatcgactatttcaaactgttcaatgatgcgctcgggcacgttgccggcgacgcctgtctgcaggccgtcggtcacgtgctggatgcgtgtgtgcgacggccttcggatctggtggcgcgctacggtggcgaagagttcgccgtgatcatgcccgacacggacattgacggtgctgcggtagtggcgcagctgattcttcagcgcttgcagcaggaaaacattgcccaccccaccagtcccgtgacccgcgtgagcctgagcatcggcatcgccgctgcgcgaggtgcgcacctggacccggtgcacggtctgatcgagtgtgccgatcaggcgctgtatcaagcgaagacggcggggcgcaacaggttcatgaagtcctctgcgcaacccttattcgacgtcgatggacagcaaaccattgacccgtgataccagtgtgtcgacggcaaaaggtttggtcagcacctgcatgcccgggccgagttgaccgttaccgatcaccgagttttccgcgtacccggtaatgaacaaggtcttgagcttcggccggatttgcctgcccgcatcggccatctgccggccattcatgccgcccggcaaaccgacatcggtaatgagcagatcgatgtgcgctctggagcgcagtgcttccagtccttcaacgctgtcggccgcttcgagcaagttgtagccgaggtcgttcagcacgtctttgagcagcgtgcgaacggtgggttcgtcgtcgacaatcaggatggtttcgccggtctttgcctgcaggattgccgagctttgcgcgtcatcgtgattgcgcggcgtttcgccgaggtagcgcggcaggtaaacgcacatggtcgtgccttgacccacggtcgattgcacccgcacctgcccgccggattgcttggtgaaaccgtaaatcatcgacagcccaaggcccgtgccctggcccaacggtttggtggtgaaaaacgggtcgaaggccttggcgatcacttcagcgctcataccggtaccggtgtcggcgaccgacaggcacaggtattgcccttcgggcatttcccgtacgcgcgccgattcagcatccagggttcgattggcggtttcgacggtaatgctgccaccatcgggcatcgcatcgcgggcgttgatgcacaggttgagcagggcgttttccagttggctggcatcgaccagcgccggccacagatcggcggcggcgaccgttttcaggcgaatgctcgggccgacggtgcgctggatcagttcgctcatgccggcaatcagcgcgttgacctcagttggccgtggatcgagggtctgtcgccgggagaaggccagcaggcgatgggtcagggcggtggcgcgtttggcggcgtcctgagcgatcagcatgtatttgtcgatgtcgttcagacggccttggccgatgcgtttttccatcagttcaagggaggcgcaaatgcctgccagcaggttgttgaagtcatgggccaaaccgccggtgagttgcccgaccgcttccattttctgcgattggcgcagcttctcttcggcctgcatcagttctgcggtgcgcgccgagacgcgttgttccagtgtgtcgttgagcgcctttaacgcggcggtgacccggtcgcgctcggcttcgacgttgcgccggtcttcgacatcgataagcaccccgggaaagcgcaaaggcgtgccgtcttcggcgcattcgacgcgtccgttggcttcgatccaggtgtatttgccatccgcaccgcgcactcggtattggtgcgaataggcacctccacgggcaatgacttcgttgatcgcggttgtgagtccttcccggtcctccgggtgcacggtcatcaccacttgctccaggctcagaccgtcgaggccccaggccgggtcgaggtcgaacacccgcgcgaagccttcatcgacgctgaagcgatcgctgggcaagtgccagtgccaggtgccgataatggcgccggcggccagggcgagctggacccgttcgacgttttcccgagcgaccgcttcgctgatgcgtaaacgttcttgcgcgtcgcgtcgttcggtgacatcgctgaagaagatcgcaatctgccgatcggccgggtcgccgacacgcacggcgcgcacatcgaaccaacgttcgaaggtattggcgtagttctcgaagttggccggctcgccggtcttggccacatggccgtaagtctcgaaccagaagctttccaggttgggcgcaaactcggtgacccacttgccacgcaggttgaccccggcctgacgttcgaacgccgggttggcctcgacgaagtaatagtcgatggggtggtcatcggcgtcgaatttgactttgacgatcgcgaacgcggcctcgatggtttccagaatggtgctgaagcgctcctcgctgcggcgcaacgcggtttcggcgctgcgcgagcgggtcaggtcgagcatcgcaccgatcatgcgttcggcctggccctcggcattgcggatcagatggccgcgatcaagcacttcggcgtacgaaccatcgtggcagaggaagcggtactcagcgctccaggtcgtgcctgaaccgtcaatcgccgagcgaatcgaagttgtcacgcgcgagcgatcctgcgtgtgaatctgcgcaaaccgccagtcacacgtcggctcgatggctgctgacgcgtagccatacgcctgttgcagcgagtcgttccagatgacctggttggtcttcagatcccagtcccagacggcgtcgcaggtcgccttgacggccagccgcaggcgcgtgacttcggactcaagctcctcgcgagtaagctctttcaggatgtccacccttcatgcgttgtgagttgtttgccttgcgtgcagtcagcgaacggccgtgagcttcacaagttttgtcagccattgacccgaggtctctggtttaagttgcacgaggtccaaggcttgcgcgctttcataacgattcgccgcgatccagtcggtcgagcagactctgcccgcgttgccacagtgcctgctgtttttcttgcggcatgcgatcgaggtttttgtacatcatgcccatgcgctgattgccgcgcagcaggtcgccgtggcgcatcagaaaatgccagtacaacgcattgaacgggcaagcgttgtcagccgtggtttcacgcaccgagtaagcacagtcgcgacagtagtcggacatccgattgatgtactggccgctggcgcaataaggcttggagccgaggtaaccgccatcggcgtgcatgaccatgccgagggtgttgggcagctcgacccagtcgaacgcgtccatgtaaatggccaggtaccactcacagatctgactcggcgcgatgccggcgagcagggcgaaattgccggtgaccatcaggcgctgaatgtgatgagcgtaggcgtgcttgaggctttggccgatggcctggcgcatgcagttcatctgcgtggcgccggtccagtaaaactcgggcaaaggccgggtgttaccgaaagcattgccctcggcgtactcaggcatggtcagccagtaaacgccgcggacgtattcgcgccagccgatcagttgacggatgaaaccctcggccgcgttcagtgcgatgctgccggaccaataggcagactcgacatcgctgcacagctgccgtagatcgagcaagccgatattgagcgcggcgctgatacgcgcatggaacagaaacggttcgccgctggccatagcgtcttgatagtcgccgaagccggccaggccgtagtcgagaaaccacgcccacaatgcctgggcgtcggcgtgtgtcaccgggtagttgaaggtatccagactgccgtagtgactggcgaagcgttctttgaccaatgcgagcacatcgagggtgattgcatcgttggcaaaaccaagcgggtagggcacctttacgtgtttaggcaaggttttgcgattgtcttcatcgaagttccaggcgccgccgaccggcgtgccgtcaccgttgagcaacaggcgacttttgcggcgcatctcgcgatagaagaactccatgcgcagctgctttttgccagtggcccatacgcggaattcgtcgcgagcgcagaggaaacggttgtcagcatgccagtggatcggcaagccacaatccttgagcgactgctccagacgccagtcgccgcactcggtgacgtgcaacgcgtgcgcctgtagcagcgcctgccagcgccttaactcggcgggtaccgagccgctgttctgcgggtcgtcgagggtcacgtaatgcacgcgcagaccctgctgctccagcgcctgagcgaagtgacgcatggcgctgaagatcagcgcgatcttttgcggatgatgggcaacatgggtggcttcctccatgacctcgaccatcagcacacagtcgtgctcgcgatccagatctgtcagtgaagccagatcaaaagacagttggtcaccgaggaccaggcacagccgatgggttttgttcatgtgcacggattcagcgtaatgaatggcagcagggcgcagagcggacgcttgagtgctaatggtgaatagttgtacagattgtagttgatgtataggtttttgtcggtcaatcaatagaaaaacagcgagctgcccttcaaaactccatcaagactgcggcattcgccacgaagctgactcggttcggcaatcctgactctcgcggcaaataagaataagtttcaattacgcaaattactggtataccatgcgccgcgttttgctggcagttctgcccttcgttttggcttattcgtaaggttctcacctcatgcgtcgaactctgctttccatctgcgtgctgcaagccttgtcgccttcttcgtgggctgaagaggccgatacaaaaacttcagccttggagctggaagccaccgacgtcatcggtgccgcagactacgaacgtgccgacgggccggtgcaaggctatcgcgccacgcgctctgccagcgccacgcgcaccgatacctcgattcacgaaacgcctcaatcgatcagtgtggtgtccagggatgccgtcgaagacctcggcgccacgcgtctgcaggacgcactggattacgccggtggcgtgggccgggcgaacaattttggcgggcaggggctgaccacgtttaccgtgcgcggcttcaccaccggcgagttttaccgcaatggcttcccgatcaatcgcggctatccgaacatgcctgacgccaacaccattgaacgtctggaagtgctgcgcgggccggccacaatgttatacggacgtggcgaccctggcggcaccttcaatgtggtttccaagcagccgttgccggaaagcaaggtcacattgggcagccaactcaacgaccaaggcatgaaacgcggcacgctggacgcttccggtccgatcgacgaggacggtcgactggcttaccgactcaatgtcatcggcgagggtggagatactttccgcgatcatgtcgagactgagcgctatggtgtggcgccggtcgtgacctggcaggcaaccgatgctacccgggtgatcttcgagggcgacttcatgcgcaacaacgcgccgctggaccgtggcgtcacgcgttaccccaagcagatcggcaccgcctcgcgtgacacgttcttcggcgagaaagacgttggcaagttgcataacgacaacaacatggcgcagttgcgtttcgagcacctgctcaatgatgactggacattgggcggcggtttccagtggctcgatggctcgctcaagggcgacgcgatcgaggcgaatggcatcggcgctgatggccgaacactgggacgcaacttcaactaccgcaagctcgagtggacagacaaggacacccaactcaacctgactggccacttcaccctgggcggcttgcagcacacgttgctgaccggcgtcgagtacgaagattacgactaccagtcgattatccagcgctccagcggtgcaatcggcgcctacccgatcgacattttcaacccggtctacggtcagcctcgcccggcattgacccggacaccgactcacgacaaagaaaatctcaaaacctacgcagcgttcgtgcaggatcaagtggcactgaccgagcgcttgaaagtgctcgccggggcgcgtttcgagcgtttcgaacacgattatgaaacctacgtgccgggcggtaaaaactggcaggccagtgacaacgcggtcactccgcgtttgggcgtgtcctacgacttgaccgacgcggttgcgctttacgccgacaccgcgcgctcgttcaaacccaacaccggcgccagtcggcagggcggtggttttgaacccgagaaaggtaaatcctgggagatgggggtgaagtgggaggcgctggatcagcagttgagcgtcgatgctgcgatctatcagatcgaaaagcgtaacgtgctgaccaccgatcccgtggactcgacgttcagtgtggcggcgggggaagtgcgcagtcgtggttttgacttgaacgtcgccggcaatctcacccctgagtggcgagtgatcggcggttacgcctatgtggatgccgaggtcaccaaggacaatgtgattcgttctggcacacgcctgatgaacatcccgcagaacagcttcagcctgctcaacgtctatgagtttcaggacggcactttcaaaggcctgggtctgggcacagggttgaagtatgtcgatgagcgcgccgggcaaacggccaacaccgcgttctcgatgggcagctacaccgtcgtcgacctgctcggtttctacaaggtcaacgacaaagtgcggctcaacctcgatgtgaagaacctgtttgaccgtgattacgaagaaggcgcgttcggcaacgtctacgcctatcccggtgcgccgagaacggtgcaggtcgggattgcctatacgttgtgattcgcagcgggggccgttggcccccgctgagatcagggcttagccggtgacgcatccttgcggtgttttcccggcaaagctgtccagcagactggccaccaccatttcccccattcgcgtacgcgtctgcaatgtcgcgctggcgcgatgcggctgcaataccacgtgttcgttgccgaacaaggcttgcggtacgttcggttcatcgacgaacacgtccagcccggcaccggcaatttcgcccgcggccaaggccgccaccaagtcggtctcgttgaccagtttgccccgtgccacgttgatcagatagccacccttgcccagtgcccgtagcacttctgcgttgatgatggcttcagccttgtcggcagcggccgcgagaatcaatgcatcgctgtcgcgggccaactgcttgaggtcggcaacgaaggtgtggttcacatcgctcattggttgcagatcggtgtagctgatcggacagccaaatgcggcggcgcgagtggcgaccgcacggccaacccggcccatgccgacgatgccgatacgcatgccggagacctgacgagccagaggcaacggtgccagcggagtcgcgctgtgcggccattggccggagcgcacgtagcgatcgctggtgcacaggccgcggcataccgacagcagcaagccgatggcgaggtcggcgacgtcttcggtcagcgcgccgatggtcgccgtcacgcggattccgcgatcccgggcgtacgccaggtcaacggcatcggtaccgacgccgttgaccgccaccacttcaagcttgggcagttgcgccatgacagcctgggtgatgccggtgtggccgccggtgatcacgccacgaatgttggcgccgtgttcctgcaaataggccggtttatccgcctgttggaagtagcgtctgacggtaaacagttcgtcgagacgcgcattgatttcaggtatcaggatcgggctgagctgcaagacttctggcttcatgtaaacctcacttaccgaataaaaggccggctcaaccgcggccggcaaacggcatggcggtggccatgacggtcatgttcagaacgttggccgacagcggcaggccggcgatatagcgcacggcatcggcgacatgcttgacgtcgaccattggctcgacggcgatagtgccgttggcctggcgtacgcctttggtcatgcgcaccgacatttcggtcaaggcgttgccgatgtcgatctggctgcaagcgatgttgaattcgcgaccgtccagcgccagggatttggtcagccccagcaccgcatgtttgctggcggtgtaagcactgctgaacggacgcggcgtgtgtgccgaaatcgaaccgttattgataatccggccgccctgaggctgctggcgacgcatgagtgcgaaggcgccacgggcacacaggaaaaccccgttgagattggtgtcgatcacgtttcgccattgttcgaacgtcagttcatccaggggcacggcgggggcattgaccccggcattgttgaagaccacatccagacgtccgtagacctcggcaatgcttgcgaacagcgcatcgacactggccgcgtcgcgcacatcggtgggcaccgccaaggcttcgtggccttcgcttgccgctagttcgaccagtgcctgcaaaggttccggccggcgcccggcaagcaccacggtgtaaccgtcggccatcaggccaagcgccacggagcggccgatgccactgccagcgccggtgaccagcgcgactttcaaaggttgagtgatggacatgttgttgttctcctgtcttcaaatcacaaaggcgtgcgagcggttcaggtccgtgggccgacgcgcatttcgagttggccgataccgtcgattccggcgttgatcacatcgcccggatgcaatccgtcgacgccggccgggctgccggtcatgatcaagtcgccggccctgagcgccacggatcgggagatccggctgatgacttcagcgaccgaccagatctggctgtcgaggctgtcgcgctgacgttcctcgccgttgacgttcaaccacaactcacctacgggatgaccggcgcgtgtcaccggcacaatcgccgtcatcggcgcggcgccgtcgaacaccttggctccttcccacggcaaaccgttgctcttggcggtgcgctgaacatcgcgacgggtcaggtcgagcccggcagcgtagccccagacataggccacggcttcgctttcagggatatcggcgccgccttcaccgatggccaccaccagttcgatttcgtgggcgaagtcttcggtcaacgacgggaacgccacctcaccgatagcatcgacaacgctgctcgaaggtttcatgaaaaacaccggcggctggcgcgactgcccttgggtatctggccatgggtaattacggccgacacagaacactcgactgacgggaaaccgttgttcactgccaacgataggcaaggtcacgggcagatccggggtgaaggcgtattcggtcatgttcatcctgttgttgtccttgtctggagagtcagcgtacggcggcaatcgttggcgaagttggacgaatgccgcctcttgttggagaaaacggtgttcgtgggctcaacgcaccttcaattcgatgcggtacaagcggcccagcaacagcgaataggagagggtgccgatcagggccacgccgccgataaaccagaaggcccaggcaaatgacccggtggcgtgaacaatcgcgccaatcacgatgggcgtgacgatgccgccgatgttggcggccaggctggtgatcccgccggtcagcccgatcagttccttgggcgccacttctgacactgctgcccacgaagatgacgcgatgccttgcgcgaagaacgcgatggtcagtacagcaatgcagatcaggttcgagtcggtgaaattcaccagcacgatggacatgcccagcattgaaccgatcaccagcggcaacttgcgggcaaatgacatcgagtagccacggcggatcagcaagtccgagacaatgccggcgagaaggatgccgaccgtggcgcccacgaatggcaggacggcgaagatcccggccttgatcatggtcagtttgcgttcttcgatcaggtaggtggggaaccaggtcaggaagaaatacagcgccgaagtgctggcgaacttgccgatgcaaatcgcccagatttgccgatagctgaacagttcagcgatctgtcgccagttgaatttggtgcgctcctgactgcttttgaccaagccgccaccggcttcgatgtattgcaattcggctttgctgactttcttgcagttcaacgggtcgcgatacagatacagccacaacacgccgaatacgatgccaagcacgccggtgctgtagaacacgtgacgccagtcgaaggtggtcgccagccagagcagggcgccggtgaacaatgccgtgcccaggtactgaccgcacacgtaaatgctgctcgccagcccgcgctctcgcgccgggaaccacaccgtgaccgcgcggctattggccggaaatgccggggcttccatggcgccgaccgccagacgcaagccgaacaacgaagcgaagcccgtggcaaaaccctggcacacggtcaccgttgaccaactgatcagtgaaacaccgtaagtgaagcgcgaaccgaagcggtcggcgataaacccggcaggcaccagagccaaggcatacgtccaggcaaatgccgagaaaatcaggcccatctcgatcttgtccagacccaggtccttggccatgaacggcgcggcgatcgagatattgacccgatcgatgtagttgatgatcgtcgcaatcagcagcaacgagagcatgaaccagcgacgtcgagagggcaggcgttgcggcaccacggcgtctcgtgggccggcgatcaccggcggcacgctggcttgggaagcatgtgaattggacatgaagagacctcgttattgttagaagaatcgagatgttttcgagcagccgaaggcgttgcccgcgagggtcggggcatagcaatcgaacggagctggctgtcggcggcggacgttcagagacgtcttgcgggcggcgtgatcggagggatgtcgggaggggcggcgaggggcaatagcaacatcatgacgtgcacacctttgattatttttggaggaggttgggctgcgtcgttgaacagtggtcgtacaacatcggtaaatcaaccgatgggttagatcattttttctcgatgggaatcgcgttgtgaaacgtgtccaagaattcaaatgggcgaatggccgaggtttttattcgaagactctttcaacatattgatagttatagaaaaaatatttctcttggttgcagggtcttttggacaggcaaaacgccaccgcccaggcaaaaaaatcattccaaacggatgtcatcgtatgactgcttgcgtgcgcggctggattttcggcaagatgaaggtcgcctgctcactgtaaatacccgtcgaggattgcgcgccgatgtcgtcccccagtcgtattcccacctatgtcatgcagcagcgcagcgagctgacggacttctatatccgcgacaaaaagggccgtcgggccgagaccgggccccatcgtcacgagtatttccagattcaggtcaacctcggtggcgacaccgtgcagcacatcggcaacgtcgtgcgtccattcccgcgtaacacgctggcgttcatcctgccgcaccgtatgcatgtgatcccgcacccggcggacagcaatttcatggtgatcaatttttcccagacctttcttttgccgcacttgcagtgcgatccgatggatctggaagaagtgtcaatcctcttggcgccagagttgtcaccattccgttttcaggagcatctggatttcattttgggcgatcaggatttccacaaggtctgtgccttgatcgagcagatgcgcaccctcgacgaaaatcgtcagtttggtacgcgtgagatgctcaagggcttgctgttgcaactgattggcagcgtgtgttttctgtatgccgaaccactcaagcgtctggccgaagagaatgcggccgaggtcagccgccgggatgcgctgagccgaatgttcgaatatttgcgcaagaacatcgccgaccccgacctcaatctgatcaaagtggcggcggcgacgtacctgtcaccgacctacctgacgcactggctacgcaaggaaatcggcaaaaccttcaccgaactggtgctcgaacgcaggatgcacgcggcgcgcaatttcctgctcaacagcacgcgctcggtgggcgaggtggcgcggctgtgcggcttcgcggacgaggcgtatttctcccgacgttttcgccagattcacggccagccgccggggcaatttcgccgccggcaactcaaccccgatacgccgcaatcgccgctcaatacctgactgtgcctttcgcctgaacctgttcgacgtactgcgacgcttcgctcggtgatgctgctttttagcctgccaacgtcgcgttatcgatcacgaagcgatatttcacatcgcccttgagcatgcgctcgtaggcatcgttgatctgatcggcgcggatcaactcgatgtcggagacgatgccgtgttcggcacagaaatccagcatctcctgagtctcggcaatgccgccgatcatcgagccggcaatggtgcggcgcttcatgatcaggttgaacacgttcggtgacgggtgcgaggtggcgggcgcgccgaccagggtcaaggcaccgtcgcgcttgagcaacacgaggaaggcgtcgaggtcgtgcggcgcggcgacggtgttgaggatcaggtcgaaacttttcgcatgcgcggccatttcctccggattgcgcgagaccacgacctcatcggcgcccagtgcttttgccgcttcgcgtttggattgcgaggtggtgaaggcgacaacgtgcgcgcccatggcgtgggccagtttgatgcccatgtgaccgaggccaccgatgccgaccacgccgaccttcttgccggggccggcgttccagtgacgcagcggcgagtaggtggtgatgccggcgcagagcaacggtgcgacggcggccaattgcgcctcgggatggccaatgcgcaacacgtagcgttcatgcacgacaatgttttgcgaatagccgcccaaggtccagcccggtgcgtccggggtcgggaagttgtaggtgccgatcatgtcgtcgcaatagttttccaggccgctttcgcaatcgtcgcagtgtttgcagctgtcgacgatgcagccgacaccgaccaggtcaccgactttgtaatccgcgacgtgagcgccgacggctgcgacgcgaccgacaatttcgtgccccggcacacagggaaattgcgtcccggcccattcggcgcggacctgatgcaggtccgaatggcagatgccgcagaaggcaatgtcgatctgcacatcgtgggcggcgggggcgcggcggttgatctgcatcggctcaaggggtttgtcgccagcgtgggcaccgtaggcttgtacaagcatgggaacatcctcaatcgtttggtcgtgtggccattgttgcggtactgccgggctgcgcagtagtgcattcctgtgcaatccttgcctgatcctgtgagtcgttgtgacgttgcgttgacagacgcccgtcgcgtttgtcgttaatctgccgactcgctgactaaaacaagataaaaaacggagtcattgatgcaaccgattcgtctcggtctggtgggctacggcaagattgcccaggatcaacatgtgccggcgatcctcgccaatccggcgtttacgctggtgtctgtcgccacccagggcaagccttgcgccggcgtggaaaactttcagtcgttggctgagttgctggaaaacggcccggcggttgacgcgattgcgttctgcacaccgccgcaaggccgcttcgctttagtgcagcaagcattggctgccggcaaacatgtgctggtggaaaagccgccgtgcgcgaccttgggggaagcgcaggcgctggttgatctggcggcagagcagggcgtcagcgcgctgttcgcctggcattcgcgttacgcgccggggatcgcactcacgcgtgactggctcgcctcgcgaaccttgcaaagcgtacagatcgactggaaagaagacgtgcgcaaatggcatccggggcagacgtggatctggcaacccggtggcctcggcgtcttcgatccgggcatcaatgccttgtcgatcgtcacccatttgctgccgctgccgctgttcgtcgaatccgcagaactgcgcgtgccgggcaactgccaatcgccgattgccgcgtcgatcaagatgtctgacgcacgccacctcgatgtgcgtgccgaattcgatttcgaccatggtcacgacgaactctggagcatcgagattcgctgcgccgaaggcacactgcgtctggacaacggtggcgcactgttgagtatcgacggggtgcgccagacggtgtcggaggagggtgaatatccggcggtgtatcggcatttccagcagttgatcgctgacaaggtcagcgatctggatttgcagccgctgcgtttagtggccgacagtttttttgtcggcagccgagtgtcagtcgaggcgttttatgacgagcgctgactaggcgccataaaccgggtaatcgacatagccttcgccggtcccgccgtacaccgtggcgggattcagcgcattcaacggccagtcattggcaatgcgcgccggcaggtcggggttggccatgaacgggcgaccgaacgcgacaaagtccgccagcccggagtcgagcagacgcgcacccgattcggcgttgtagcgcccggcatagatgatcgcgccgctgaaggtgtcgcgcaccgcctgacgaaatgtctgcggcatcgccggggcgttgtcccagtcggcttcggcgatggacagataggcaatacctacgtcttccagcaccttgatcgcctcgatgtaggtggtgtgaggatcttcctcgaccatgcccagataggtccgcgcttcatcggtggtggtgaacagcggcgcaaagcgtacaccgactttttccttgccgatgcactcggcgacgccggccaccacttccttcagaaaacgcaggcgattgtgcagcgagccaccgtattgatcggtgcgcaggttgctgtgggcagagatgaactggttgaccagataaccgttggcgcagtgcagttcgatgccgtcgaacccggcttccatcgcattgcgcgccgcttgaatgtacagctgaaccagttcctggacttcgtcggtgctcagtgcgcgcggcgcggccggcggcaccagttcaccggcaccgggcgcggtttcgatgaacacgctgacacgatcagtggccacggcggaggcggacacgggagcggcgccacccggctgcaacgcagtgtgagagacgcggcccacgtgccacagttgcgcgaaaatcacgccgtcgacggcatgcaccgcttcggtgactttgcgccatccggcgatctgctcaggggtgtgaatcccgggtgtccaggcgtagccctggcctcggggttcgatctgcgtgccctcggtcaccagcagaccggcgccggcacgctgctggtaatactcggccatcagctcattggcgatgttgcccggttgcgtgctgcgctgacgtgtcagcggtggcaggacgatgcggtttttcagggtgtgcaggcccagttttgcaggggtgaagtaggggctattcatgtttattagaccagtcaactattaaatgggggcgaaaaaaacgccgcgcaacacgcacggcgttcagaggacgtagacgctgggtctcagcccaacatcttcagcagtttttcagcgacagcggcagagctggcggggttttgaccggtcaccaattttccatcgacgaccacatgaacctgccagtcagcgactttcgaatagtggccgccgagacgctggaactcgtcttcgatcaggaacggcaccacgtcagtcaggccgacggcggcttcttcggcgttggtgaaaccggtgacttcgcgatgctggatcagcggtttgccgtcagctgcgagcacatgacgcaataccccgggcgcatggcagacaaaaccgtgcggtttgttgctgcggtcgaacgcttcgatcagggcgatcgagtgtttgtcttcagccagatcccagagcgggccgtggccacctgggtaaaacacggcatcgaaatcgtcggcgcggacatcggccagcaggccggtattggccaatgcctgctgggcagccgggtcattgcgaaagcgatcggtctcggcggtttgcgcatcgggctcatcgcttttcggatcgagcggaggctggccaccggctggcgacaccagcgtgatgtcggcgcccgcgtccttgaaggcgtagtaaggggcggcgaattcttccagccagaaaccggtttttttgccggtgtcgccgagctgatcgtgggaagtcagaaccatcaagattttcatagagcaccctgggttggtcaggtgatagcgctgcacgaggcattcgtgtcgcatcgacacccgatgaattaggttgacggagcgcagcatagtttcctattagaccagtcgtctagtaattttttcgacggaggtttttcccgcccggctgtggcaaactccgcagcctgtgaaatatacgactggtctattgtctggactttgcgccccatgaaaccgacttacgacgatacgcgccaacacttgctcgacaccggccaccggatgatggccgagaagggcttcaccagtgtcggcctcaatgaaatcctgcaaaccgctggcgtgcccaagggttcgttctatcactacttcaaatccaaagagctgtatggccaggccttgctcgaggattattttgtcggctacctcgccgacatggagcgacgcctgacactcccggggctgacggcgttcgagcggctgatggattactggcagggctggcaaaatcgctgcaccctcgaaggccatggtgatgagtgtctggtggtgaagctcagcgccgaggtcgccgatctgtccgagtcgatgcgcctgaccttgcgcgacggtgccgagcgcgtggtggcgcgcatcaccgtgtgcatcgaagaaggccagacgcaaaagagcctgccggcgggcgatgcgcggcatctggcagagacgttgtatcagctgtggctgggtgcaagtctactcaacaagctgcagcggacggggcaatcgctgaacacctcgatggcgatgaccaagcaactgttgcgcgtctgaggccggcatgcccggtgcatcagccgtttacccattgctcgcgaaattgcagcagaaaatccacgaagacccgcacgtgctggggcacatagcgaccgtggggatacagcaacgtgtacggtcttgagcgaccgctgaaaggttcaagcacctcaatcagactgccatcggccaactcccgctcgacgatgaaccgataggtctggaacagtcccgcaccgtgtttggccagggtgacgccaccgagcacgtcatcggagcaggaataacctccggccgcgagtacttcacgatccttgccattgtcctgaaatagccaggaaatctgtcggccgctgctcggcagttcgaactgaatgcattcatgctcgagcagatcctcaagtgtctgcggcgtacccgctgcgtgcaggtattgcggcgaggcgaccaccaccagtttcgcgtcttccagcaagcgcgcaatcagggtcgagtccggttgtgcgcgcacgcgaatcgccagatcgtaaccttcgccgacgaaatctatattgcgattgcccaaatggatatcgaccgtgacctgcgggtatagcgcccggaatttcggcagcagcggcaggatgcggtggtggccgtaagtggtgggcaggctgatgcgcaagcgccccgacggcgtggtctgcgtgcccatgacttcttgctgggcttcgaccagttgggccagtgcctgactgcattgttcgaagaatttcctgcccgcgtcggtcaagcggatgctgcgtgtggttcgtgtaaacagccgcgagccgaggcgtttttccagacgcagaatcgagcggctcaccgccgccggtgtcacccccgcgagcagtgcggcagcggtgaagctgccggcgtcggcggcgagacagaagagttcgatactgcccaactgcaaatcttcaaagtggcgtttcatcatggctggcaccgaggagcattcctccagatgtttaccacatgaatcgccacccgcgctgaagtggcgtcgtgatcaatgccccgcgctctggccaccgtcgacatgcagaatctcaccggtcacgaacttcgcggcgtccagataaaggattgcctgcacgatgtcgtcgatctcacccatgtggccaagcggatgcagattgcccagggctgcgtggctttcttcggcgtgcatgggcgtcttgatgatgcccggcgacaccgcgttgacgcgaatcccgcgcttggcgtattcgatggccagggatttggtcgcagcgttgatgccacctttggtcagcgaggccagcaccgacggcacgccgtcaattgcatgatcgaccagactggtagtgacgctgaccacgtgtccgctgccatgcttttccatttcggcgatggccagttgcgaaatatggaagaagccgctcatgttggtggccaccactcgggcgtagtcttcccggctgtacgcggtgaacggcttggcaacaaagatgccggcattgttgaccagcgtatcgacgcgaccgaaacgttcgacagcggcacggatcacccgttcggcagtttgcggatcggcgatgtcgccagcgatggtcaatacctgcggatcagcggattccttgatcgagcgcgaggtcgccacgacctgatagccacgctcgcgaaaaccattgaccagacccgctcctatgccttgcgaggcgcctgtgataacgacaactttgctggatgtgctcatgatgatttcctcaggaattgaagattaattgcccgacaacgattggcggtattcggtggtggtcatgcctgcgtagccccagttatccgtatcgacttcctcgatcacgatgtgcgtgagctgcggatccttgttgagcactcgttgcatggtctcggtgatttccttgatcacctgggctttctgctcccggctaacgccgtcgcgggtaatgcgtacgctgatgaaaggcatggactgtctccgatcgcaggcccgtcggggtgaggggctgctgttggagagaactgtaggaagttgtcagtaattgataaatgcgccttgaggtacttcatttatgccgtggtgtatcgaatggcagcggttgttcacgcgattgtccgtttcaggttgacggtgaaacacattccagccgatttatcccttttcgatgcgtcagtaatctgtacccaacttgaacgcaacaacaaattcaaaaactcaaaagggaagcagaccatgaccactccaacctacaaccgcctgaacaaagacgacgctatcgtgctgctggtcgaccaccagaccggcctgatttcgctggtgcaggacttctcgccgaacgaattcaagaacaacgtgctcgccctggctgatctggccaagttcttcgaactgccgaccatcctcaccaccagtttcgaacaaggcccgaacggcccactggtgccagagctgaaagagatgttcccggacgcgccgtacatcgctcgcccaggtcagatcaacgcctgggacaacgaagattttgtcaaagcgatcaaggcgaccggccgcaagcagatcatcattgccggtgtggtgacggatgtgtgcgtagcgttcccgaccttgtcggcgctggcggaagggtttgaggtgtttgtggtgactgatgcgtccggcaccttcaacaccacggtgcagcaggcagcatggagtcgcatgacccaggccggcgcacagatgatgaactggttctcggtggcgtgtgagctgcaccgcgactggcgcaacgacattgaaggcttgggtaatctgttgtcgcagcggattcccaactaccgcaacctgatgaacagctactcggcgctgaccgcgcagcagaaataagcctcaagtgcgccaagcgaaaagcctgccctcaaaagcaggctttttttcgttggcgcgccgttcgtccagtgcccggcacttgcgccgcgtcgttgtctctcacgttcaggcacggatttcccgtgtgtcagaacggagagcgaggcatggacatcgatgaaaacgcaccgggcaaccggtcacagcaagaagtgacgcgaacgaccgacaatgagacggggcatgacccgaaacgcgatcagcccgaggttccattgcccgccgatgacgaggcgctgctcgatgaagacatgacggacgtggcggccaacaactcggtgtcgagtgagcatcccgagtcgcaatgattgaattgaaccagtgttgaggggcggaccatgagcaggtcattcaaggtcggcgacgcggttcactggaacagcgaggccggcgagattcgcggcaaggttgtcaacgtgcacacccgggatgtcgagttcatggggcgccaccggcctgcttcaaaggaagcaccgcaatacgaagtcaaaagtgacaagaccgggcatctggcgatgcaccacgcggccgcgcttcatcccgcgaactgagcgatctaatgcgacgacacatattcagatgacgttgtcggtgccggcaacgcatacgtcgccttcatccattcaatctcggcctgcggtgtccggccgaaaaagcgtttgaactcgcgactgaattgcgaggcactttcatagccgacgtcgaacgctgccgccgatgcgctcatggcttggcgcagcatcagcaaccgagcctgatgcaggcgtgtcgacttcaggtactgcatcggcgaggtatcggtcacgctgcgaaagtgcaggtgaaagctcggcacgctcatgctcgcttcgtgggccagttgctcgacgtcaaggcgttgctgataacagctgtggatcttgcggatcgctcggctgaccttgccaaaatgcccctgacgctgcagcgcggcgcgcattgagccaccttgcccgcccgtgagaatgcggtaatagatctcccgcaccagcgctggtccgaggatctgcgcttcaccggccacgctcatcgcctcaagaaaacgcaaggtcgtggcgcgcagtgcgtcgtccatcggcgaggcgtacatgcctttgggttgggcatcgctggcgccatgcacctcatcgacttgcagcatcaactcgctggccagatggaaatccaggtgcatgtaaatcgcgagcatcggctcggccgccgtggcgtcggtctccatggtgaaaggaatcggcacggagacgacaaggtagtgctgggcgtcatagacgtaggtgtcttcgcccagataaccgcgtttgcgaccctgacagaggatgacgatgccggggtcatacagcaccggggtgcgggtcagcggccgattcgagcgcaggaaacgcacgtcatcgagtgcgctgagggtgtagccctcgaccggcgcaagggtgtccatgagttgcaccatgcgggcggtggttgcatcggcctgggtcattgcgtcctctgtcaatggtcggtggagcgggtcagggcttgccattgatcgatctcgtcgagcgctcgttgcagcttgtcacgcaccagcgacaaagcatcgctaccgagcagcagatgggcgggcggcgtcgggctggcgatgatctgcaacagcgcttgcgcagccttttgcgggtcgccgagctgtttgccgcttttctcttcccgggctttgcggatcgggtcaaaactggcgtcgtagtcggcaatgctgcgcgcggtgcgttgcatcgagcggccggcccagtcggtgcgaaacgagccgggcgctacagccgtgacgaagatattgaaaggcttcagctctttgctcagggtatcggagatcccttcaagcgcaaatttgctcccgcagtaataggcgatgccgggcatcgtgatcgtgccgcccatggaggtgatgttgaggatatgccccgcccgacgctggcgaaagtagggcaggaaggccttggtcatggcgaccgcgccgaacacattgacgtcgaattgcttgcgcatgtcgtccagcggcgactcttcgaaaatgccttcgtggccataaccggcattgttgaccagcacatcgaccgggccgtgagtcgcttccacctcggcgacaacgctgtcgatccgctggaagtcggtgacatccagcagcactgcgtatgcattgtccggggacagcgcctcgaagttttgcaggtcggtttcattacgcaccgtaccgatgacgcgatgacctgcagccagcgcggctttggccaaggcgtggccaaagccgctgctcgcgccggtgatgaacagggttttgctacggttcatgacaatctcccaaaggctggtgtgaagtcatggtagcgatcaggccgcgaggcacctatgccggttcgtcttgcagccttgcctattcctatgaaccgcccaacgggccgaacatctcgctgaccctacggatcagcgcggcggtcggtgctccataaccggattgccaacaagccacagattgtggcgccacgctcacttctgaccgacatcaaggttctctgatttgcggttcattcgcgagtacgggctgaccatgcgattcagtcaacagctcgcgtatccactgcgcctcctgacgaacgtccgcgattttgtcttctggcaacgcctgttgcgcgcgggcgaggtggctgagggtcttctgcttgtggcgaagtttgtgctgccatttgatcaggaatgccgggctgcgcgcctgcatctgcaagggaccgaaatacaactccttgtcggtgtagctgaccgcttcggcgcgttcggcgacgatgatttcgtagtcgaagcgactttcgcgcagcacttcttcgctgaggatgcggtagccattttccatcaaccacaggcgcaagggttgctcgccaccgttgggctggaggatcaagcgctcgtcgccgctcaggtgcgttttgccgttttcgagaatgtcgcggatggtctcgccgcccatgccgcagatgctgatcgcggtgatccggtctgcgggattgatcgccgccaggccattggcctggcgcacggtgattcgcgcttgcaggttgttttcacgcaccgtgcgctgcgccgcctgaaacggcgtcaacgccacctcgccggccactgctgcctcaatcgcgccacggcgcatcaacgccactggcagataaccgtgatcggaaccgatatcggccagccgcgcaccagccggcacgtgtgcggccacacgctcaaggcgaatggacaaagtgttttcgttcaacggcaacccctgatttgcctgctgtttgcggcatcgttggcgggaaaaaggggtgcgactttgtcgggctaaggttggcctgtcaaattctgtcgacgaaattgaataatcaattagcaacgctgagcactgaatggatgcgagcgcttgtttcaggccgcgacgccgaggagttatcttgtaatagaaacctgaacatcgaacttcacatcccttcgtgtctagtcaacaatgcgcgcactgttccggggtagttcagcggtggaacgctcggctctggaccgagtgggcgctggttcgaatccagcccccggacccattttttacattgcagagtcacagggaagtatgtccaggcacgacagtgaattcgacgagcgcagtggagtgagtgccggttatgcggtgttccagctctcgcgggcgttgaccgcttcgcggagcgatgcgggtcagcaggcacgcaatcgtatcgagcgctggcaacgggttgtcgaacatctgctgcagggcagcgcacagtacggtttacgcatgccattcgccgatttgccgacgtgggtcacactggaagtggtgacaggtggatttgccactgggcgactgattgctggtggtgctttgactgcctacgagcgccagttggctgcgtcgattcctggcatccgtgccggtcatgaacggctcgatctgaatgcctggcacctttcagatgcaggagtcgcatcgctgcaagaacgtttggcgaaaggcagttatcaaatcgatgttccggaggaggccgcactgctgacagtgtcatggcttctgcggcatcagcgtaatgacgaagcgcgaacgttgatcgaacagatcgcacctttcttcgaaaggctgcgtttcttcccgactgccgttgacgaaccactgatctcgacggctgaggtgcatgtttttgataccgccagtgtcaggcagcggctgacgcggcaatcggctcaaccgcgtctcgctgttcaaaaacatgttgtagaaaaccgactgcctctctacgacgctgcggtctcactgtttattttgacgtatcaggacggctggccttgccgacactatcctgacggctggtttgagcgcgcaaccttactcggcaagcagatcgctgaaacctgtggcactgaattcaatagccgaggacccttcaagaaccgggcagcagaactgtttgcgttactcgctcagagttcccgtgatcaagcagcattgacgggccgagacgtcggtcgcgtccggcgaattgtcgatgactttgtcgccaaacatggccatcccgaatcccgcgcacactcgattaaacgggaagagcagcgaaatcacgtggctgcccccggacatcatttgatcgcccatgctgtagcggagcgtctggaaaattatccgggtgcggacggcgtcgaggactttgctccactgttgaaacctatcaccgatgaagagacgaagcgtcacgcactgatcgtagggacgatcattccggctgctgttcgccgacgcctggagcgttgccgcaagggcacaatcgccgagctgattgaccatggcttgatctcatccggcgatactgtggcgcaagtactgcctgcgatgacggctgaaatctgtaacgccggatatcgagacggaacgcttcagacattgggaggtgctacgtaccgtgccttccgccgtcggcggtcattgttgctagtcaacctgcaaagtcaggtcaaaattgcagagctgccttgggtaatggctttagaagctgagcgtgagacgaacgccaactccgttacgggcgctagacaagctttggttgaagcctccgcgttaactctctctgcgtttccgcaagcgattcttcctaacaagttactgcaggagtttgtttctctggctcaaacggctcagttggaccttcccttcgtcgaggaagtggctgctgacattttcatggggactttctccaacaaattttcgagagcggccagacaatcggccaagctgatcgctggaacgctttacgcccgctattacgacattgatacagatggactggcgagccttcccgatcaccgccgatcgcggcgcagaataaacaactctgatgcattggcgacgctgtgcgcacagcgagcaaatgccgtcctgggcacgtggcagccagcagtcaacggtacaatcctcgaacagcaacagatcctgacaacacaaaacctttcggtattgtttggcgaactcgagctcaaaatactgctgcaacaccgtctaagtgcattggcgctgtcgtgctttaaatggatctgcaaacgccaccaaacgcacctatcgctctaccatgctcgtctgctgatgttgaaaaacaccgcgtatgcgtggcgtcagatgatgttttatctgtcgatgctggatggagagcttttgcattcggcactcgaaagtcttgaagcgcattttgcgacgcaatccggtgagttccgagaaagatttctgcccgccatggtcgggttgcgtgttgccgctgcaggaaatcggctgacgctgagtcgccaaaaggatgagggtgcaaaggtttttttgggttggaccactgagcgacattggctaatgccctcgtaacatctttgtctccagaccacaggaaatctccccgagcacaaaagcctgctctcgaaagcaggcttttggatcaagcttccgtttcaaaaacgattcagcctgtacggttcgctgactggcaggctgcaggtctttgttaccaccgtaggcaaagccatccgcaccaccatctccgccgtcaccgccgcctgcgtcaaccctaaatgctgatgcccaaatgcaagcaacaccttgccatcacagacttgatcaatcaccggcaacgaatccggcaacgatggacggaagcccatccacggtgtcgctgcttcggcactcagatccttgcgaaacaaaccttgactcaatcgatgcagttgccacgcgcgctccatgctcggcggcttttgcagtccggcgaactcgacggtgccggccaggcgcaagccttcggtcattggcgtcatgatgaatttgcgctccagcgaggtgacggggaagggcaggcgatcgtgttcctgcggcagcatcaggtgatagccgcgctcggtgtccagcgggactttttggccggtgagtgcggcggtgagtttcgccgagtgcgcaccacaggcaatcagcacgcggcttgcactgacgccgccgttgccggtgaccagcgaaacaccgtgctcctgcacataacccccttgcacctgttgttgcagaaatctcacgccgctggctttcgccgcttccacgagttcgcagaccacgcgatacgggtcgatgaagtgcccggtgcacgggaagaacaggccgccctgaatctgttcgctgagttgcggcgcggtgtcgcggatggcgctggcctgccagtaatcgaccgcgacctgctgctgagccatgcgcacttgcagggcttcgatggcttggcgggattcaggcttttcgaacaccagtaatgaaccatcgaccttgagcagatcaggacgctggatatcgctgagcaatcgatgccaggcgtcgagactgctttcgttgagcgcgcgcagtccggcaacggttttctgaaaaggctcggcgcgcaggttcaacaatagccgggtgaaccacggcaaggcgcggggcaggtatttccagtccaggcgcagcggccccattgggtccatcagcatcgccggcaggcgtttgaggatagaagcgtcggcaatcgggaacacttgttcggtcgccagatgcccggcgttgccgaacgaggcgccgtggccgggcggttgctgatcaatgaccaccacgcgcaatccctggcgcgccagacgcagtgcgcaggcgacgccgatgatgccggcgccgaccaccgcgatgtcgcaggagacgttattggccatggtttgaggcttccctttgcccgtcgagcaagcgccgcaagtgcagcggattggcctgtttcagtgcggcgggcaacagactgtcggggaagtcctgatagcagaccgggcgcaggaatcgcaggatagcggcggtgccgaccgaggtcgtgcgcgcgtcggaggtggccgggaaaggtccgccatgcaccatcgcatcgcagacttccacaccggttggccagccgttcaccagcaggcgaccggccttgcgctccagtgtaggaagcaaggtgcgagccagttcaaggtcggcgtcgtcaaggtgcagggtgacggtcagttggccttcgagttgctcggtaacctgacggatttcatcgtcgctgctgcattgcacgatcaacgacgccgcgccgaacgcctcagcttggaggttgtgatcgctcaggaaattcgctgcttgcgtgacgaagacatgcgcctgcccctgattcgcgccggtgccgatttgccccgccgcaacgatacgcgcaccggcgttttcggctagcgccttcacagccgatgcgtaagcgttgtagatacccggcgtcagcatcgtttgcgccgcacgagtctcgatgcacctggctgttgcccccatgaactcatcgagggccgggcctttacgggcaatgaccaatcccggattggtacaaaactgtccggcgcccaaggtcagcgagccgacaaacccttcggccaatgcctgtgcgcggttttgcaacgccgccggaaacagcaacaccggattgatcgaactcatttccgcatacaccggaatcggctcgggcctggcctgcgccgcttgaatcaatgccaatccgccagcgcgggaaccggtgaagccgacggctttgatgcgcggatcactgaccagcgcaatgccgacttcgcggccagaaccgtacagcaacgaaaaaaccccttcaggcataccgcaggcttttaccgctcgagcgagcgcgtggccgaccagttcgctggtgccgggatgcgcgctgtgcgccttgaccaccaccgggcagccggccgccagtgccgaagcggtgtcaccgccggccaccgaaaatgccagggggaaattgctcgcaccaaacaccgccaccggcccaagagcaatctggcgctgacgcaaatccgaacgcggcaacggttggcgctgcggctgtgcgttatcgacacgtacatccagccattcaccggcgcgcacggtgcgcgcgaacattcttaattgttggcaagtacgcccgcgctcgcccagtaaacgcgctgggggcaggccggtttcggtgtgtgcgcggttgatcaattcatcgccgagggcttcgatttcagcggcaatgctttccagaaagtcggcgcgggcactgagggtggtttcgcggtaggcgtccagcgccgcccaggccaatgcgcacgcctgttcgacgtgctcggccgagccaccggcataggccggttccagcgcagcattcgtggccgggttgattccgtgaatggcggcgcggttgcccgcaaccgtgtgctgcccgatcagcatgtggcccgtcagagtcatggtgtcttcctgatgaaaaaagagggaggcctgccgcgcagcacaaggcttcgcggcagctgaggggagggtcaggcgaagttctcttccgccgaccagttctcgtaccagtgacggaacagcgagtactgctgctcggcataacgtcgttgcgagtcactcaacgcatcggtttcgttgaagtgcagggtgtattccttgtcaccgttgagcaccatcagatgtttgtaatacagcaccagatcgcagccctcatcgaacgacgacagcactgccagtgccgattccagttctcgcgcctgacgtcgggccttggcatcacccttggccgctcgcttgctcagcgctaccagttgcagcacttcgcggggcagggcgttgccgatgccggtgatggcgccggtggcgttgcagttgacgaaaccgtgcaccacttgcgtgtcgacgccgaccatcagggtcacgtcatcgtccttggaggtgatgttttccgcggcgtaacgcaggtcggcgccaccgccgaattccttgaagccgatcaggttcggatactcgtgacgcagttcgaagaacaggtcagcgcgggtggcgaagccgtagtaaggactgttgtagatcactgccggcagattcggtgcggcttgcagaatggccgcgaagtgagccttttgcgcggccggcgaagcgccacgggacattacgcgtggaatcaccatcaagccttgtgcacctactttcgctgcgtgcgctgcgtgggaaaccgcttcacgagaattcaccgcgccggtgccgacaatcgtcggaataccggcggcgaccagacgcgccacgccttcctgacgctcggcttcggtcagcagcggccagtcgcccatcgaaccgcagtagaccaccgcgctcatgccgatatcgatcagctcgcgacccttggccaccagtgcgtcgaagtccggtttgcgttgggcggtgcacggggtcatcagggctggcatgcaaccggtgaagatgttgtcgctcattgttttaactccttggcacatcattcaaattgaggtgaaaagtcagcgcggcggctcagatgccccacgcgaacgggtcggtttcgtcgatcagcagcgtgctgtcggcggtcatgtacgcgcggccagtgatgaacgggcgaatgcgttcgccctcccattcgaagcggccttcgaactggctgccggtgatgcttgcctgcacccaggtcgcgccgggttgtagcttgtcgtcggcggcgaggcaggcgagtttggcgctggtgccggtgccgcaaggggagcggtcgtaggctttgccggggcacatgacgaagttgcggctgtcggcgttggcgtcgtcagcaaacagttcgatgtggtcgatcaccgcgccgtcttcgccgtaaatgccttggtcttcgagggccttgagcatcgcccaggtgtaggcggtgaggtgttcgacgttgtccatcgtcaacgtttggccgtgctccgagacgaggaaaaaccagttgccgccataggcgatgtcacccaatacctggccgaatcccggcacgtccaccggcacctgtttgcggtggcgataggcggggacgttgcccagcgtgacggagccattgtcatgcagcctggcactgaccgggccgaccggcgtgtcgatcttgtgcacgcccggctggatttttcccaagtactgcaacgaattgatcaggccaatcgtgccgtggccacacatgccgaggtagccggcgttgttgaagaaaatcaccccgcaggtggcgtccggcgagaccggctcgcaatacagcgcgccaaccaacacatcgttgccacgcggttccagcaggcaggcgcggcgccatgcatcatgctgattgcgcagggcatcgcgtttttccaccatgctgttgcccggcagattagggaaacctttcatcaccaggcgcgtcggttcgccgccggtgtgggaatcaatgacgtgtagttctttcatgaatggatcccgttggatgagttcagtaagcgccggcagggcgcgcggacacggttgaggcgggcgctacgacttcgctttcctcgtcatcttcttcaagacgcagcaggtgcgccggtacgcctgttgcggcgccccagtaataaatgccggtggcgcaagcggcgacaacgatggtgtcgaaagggtgagtgaggatgccgagaccgccgaaggtgccgagtttcgacaggacgatggtcaccgcgtagaaagcgatcagccacgccgaggagcgcacctgacgggccagattgaggtgagcggtcggcacgaagcggccgcacagcagatacaccacgaacatcaggatctgcaggccaagcagccatgacacggtgctccagcctgaccagtaaacgatcagcgcggcgatgatgaacgacaccggcccgagtacgcccatgcacttgacccggaacgggcgcggcatgttcggcgcgttgcggcgcagggcagccacggaaaccggggccacggcgtagctcagcaccagcgcagcggagaccacgttgatcagcgcttcccacgacgggaacggcagggtccagaacactgacagggcaaaggtcagccacaacgccgggcgcggaatgccggacttctcatcaatgtgggtgaagactttgaagaaggtcccggtctgcgcccagccgtagatcacccgcggggtcgcgttcatgtagatgttgccgcagccactcggcgagatcaccgcgtcggccaccaccagatacgccagccagcccacgcccagcgccaaggcgatgtcgcgataaggcagggcgaattccttgctgataccggcccagccgttggcgagcatttcggtcgggatgctgccgagaaaggccatttgcagcagtacgtaaatcagggtcgacagcagcaccgacaggatcaacgcaatgggaatggtgcgctgcggattcttcacttcactggccaccgagatgatcggcgtcagtcccagataagcgaaaatgacgccacccgccgacaccgccatctcgacaccggacaggccgaacggcgcaaagccctgaacctcgaagttggccggtttgaagaaggtgaacagcacacctatcaccagcaacggcacgatgaacttgaacacgctgatcaaattgttggccttggcgaaggtcttcacgctgcgatagttgagcaggaaaaacacgcacagcagaccgaactgcaccatccagccgagaatcgtcggatcgccgctgccagccttggtcaggccgggaaaccacgccgccgcgtattggcgcgaggcaaccacttcgatcgccaccagactggaaaacgcgatcagcgtgataaagcccatcagataaccgagcagcgggccgtgggagtaaaccgggtagcgcaccacgccgccggcacgcggcaaggccgcgcccagttcgcagtaaacgatgcccagcaacagcacggcaaaaccgcccagcagccaggagaaaatccctgccggcccggcaatggcggacacgtgactggccgcgaacaaccagccggagccgaagatcgcgccgagtccgataaatgtgaggtcgatcagtgaaagctgttttttgaacttgccttggcctgacatggcatcgccttcttgtgagttattggataggcagttgtgtcactgggacggccagactttgaactcatcgagggcgcggcgattgatgttttgcgatgggttggatgacgaattcagcacaatcgcccagatgaaacgctgctctcgacatgcgctgagcgatgctgcaatctgcacgcgaacgccgcagggcgggcccttggccaatctacgtcacgaggggggattgtttgatgcagcacgcgttttcacgcctggcccaaggcgttggcggcaatcgtccgcaaacccttgaagagctgttggccggcgcggcattgctgttgccgatgctcgacgtgatccccaatgcggcgattttcatcaaggatgtgcaggcccgttacgtcctcgccaatcgcacattggtgcaacgttgcgggttaaaagacttgcgtccattgctcggtaaaaccagcgcacaggtatttccggcgcaactggggccgggctacaccgagcaggatcgcaaagtgctggaggagggctttgtgctggaggaccagctggagttgcatctgtatggcagccgcgaaccgggctggtgcctgacgcacaagcagccgttgtacaaccgcgatggcgagatcatcggtctggcgggtatctcggtcgatctgcaatcggccagcgaaacccacccggcattcgagcggctggccgctgtcgatgagcatattcgggcgaacttcaatcgccgtgtcaccctcggtgaactgacgcgaattgccggtatttccgtcgcgcaactggaacgctactgcaaacgcgtgttccacctgacaccccggcagatgatccagaaagtgcgcctggaacatgcccatcgattgctgcatacggacttgccgatcactgaggtcgcgctgcaatgtggctacaccgatcacagcgcgtttacccgtcagttcaaggcttcgaccggattcaccccacgccagtaccgccaggcgacggggcactaatggcctgctatggaggcgagaagagacattgaaccatgaattgtggctggagcctgatggcttggagttgttcgtagtgtccgggcctcatggtgatgaggcgcgagcgctgcttgaaccggggtcgaagctggtttgggaggtctgcgccgacagctattttgacgcgatgacccagtactatgcgtacatggattggggggtatggacgaccgactttccagagcacgataaaaccagttaccgggatcgtggttgggacaccagcccaaaggggaaataaagtcagtgttgccccccctgtaggagcctttcaggccagtacggtgagccatgccgacagcagcagtaacgacgccagtactgcgttcatgcgcctgaacgcttgcggtgagccgatcaaccgcctgctgcccacgcccagcagcgcccacaacgtcatgcacggcaacgacaccagcagaaatgccagcgacaacaccaacagttgcagcgtgttgtcgccgcctccgacaaacacactgaccactgccatggccatcatccacaccttggggttgaccagttgcagcgttgccgcgccgagcacgctcaaaccttgttcttgctgctctgtcgggttcagtgatggcggtgcactgcgaaagatctgccaggccagccaactcaaccagagcacgccgccccaggccatggcttgctgcacacgaggaaaacgcagcagtgtttcgccggcaccgaggcccaccaccagcacgatgagcgccgccgctgcgcaggcaccaaaaatgatcggcagcgtggccagcaagccttggcgcgagctgtggctcaacaccagaatattggtcgggccgggagtgatggacgcaacgaaagcaaacagcaggaagggcagtaatgacgccatggtgcagattccctgaaagtgaacacagggggccatgattactcgtcaatgtgcgtcagtctggaaggtttgagcagcgcttgcggtagtccgccggtgtcagttggtaggcgcggcggaaccagcgccccaaatgactctgatcggcaaaacccagcacgctggccacctgcgccggtgtttcaccgcgtgcgagcaactgccgtgccttggccaaacgtagctggatcagatacgcgtgcggcgccaggccgaaggctgtcttgaaggcgcggctcagacgaaaacgatccaccccgcaaacgcgcgccaggtcatcgaggccgatgtcttcataggcatgtgcgtgcagatagtcccgcgccacttgcgccaccagcggcaggcgcggatcgaaatcctgacgcttgcgccaagcgagatggcccgtgagcgagcccagcagaccatcgatggcggtttggcgaacgatgcgcaagtcgccgtcgtgcagtgcgtggaaggcttgatgaatggctgtagccagacgcgggtcctggctcagggtgtcggcaaaaccgggctggctgtcggaaggcgcgtcttcgaacagcgcgtgcatttcgcgctccagccaatgcgggtcgaggtacagcatcgaataggtaaagccgtcctcggtcggtgcatggccatcgtgtatctcccccggttccagcaagatcgcctggcccggcgtgctgcgatggcgcacgcggcggcaattgaactgctgaacgccttgctcggtgaccccgacgagaaagctgtcatgccagtgcgggtcgtaggcatgcccttcgaagtgagcacgaatcgattcaatcccggtgtcgacatcctgggacagatcgatccagttgcgtttatccacggaaggctccagggctcggctttgaaaaatgcggcctcataaaataccgcgcaacgcagctgggcgtttagaagatttgtgcagaaaggcaagtgcaaacggctagactcaacggcacacgaccctttagcgacaggtgcaacgcgatgatcgaccgacgctcgccatgggttctgcctaccctgatcgtcttcagcctgacgctggccgccggctgctcgaaccgcaagcattatccaccctctggcgtcggcgacagctgttacgccaaggccttgccgaccgttggcgagggaggtctggcgtggggctccagcctgaacatggcgcggcagaaatcgatgaataactgcatccgctacgccggccgttcaggcggcacgccgaatacctgtcaggtggtgttggccaagtgcaaatagcgtttcattggcttgggtgcgttggttgtgtgcgtatgaagcagcgatttccaggcgaaaaaaaaccgcctttgcggggcggttcttttgtaaacctcggtttgcggccggggttggtgcttcactagccaaactgacgtgcaggaatggtaggagcctttgcgtcaccttgcaacgttaatctgtgctttgatccggtttttttagcattgtttattcgaattaatcatgcagaaataacgatttacaaaagcagaaagtttctctgcatgagaacctttgattgaaggttatgatgccgacgctcagatgttcgttcgaaggtgaggtctggctggcaactcaacggtttcattccctctgacacggttttgcacccgtgccgggatgatggttcagagggcattcaaccggccgcctcactagccagactgacgtttaggctgaaggcacgcatgatccggtaagtttgctggaggtttggccccctgacctggaggccaaaacgtatgaagcatttgctgcgtacgctgagcctcgtatggagatcgttcaaagcgttgagcttttacgaattcctgcgagaccactttgacgatctgaagtaacgaccgttactgtgggaaaacccgtttcagtcttgtgctgggacgggtttttttgtttgtataaagctgtcaaaaatacgaactttctttttttcggtctgaagggctgtagggcgtttccattggtggctgtaggcaatcatcgcgcggcccaactattgactgcatcaataacaaccattaattcaatgaagttctcatatcagtaccgcggcgtaagatcggctccattcccaaccacgcaatcggagcacatcaccatgaaacgccaagtccttctcggtatcgctttctcgatcttcgcactgaatgcttttgccgccaccgaaaccgatccattgttcagcgatgcagttgccgctactgaaaccgatccattgttcagcgatgcagtcgcggccactgaaaccgatcctctgttcagcgacgccgttgcttctgatggctcggatcatctgcaaggcaatcgggtcgcagaaggtggcgcggatcgcctgatcgaacgccgtgcagtctgaatgcacgcgcttaccgcagcagccaacgaaaagcccggccagatcagccgggctttttggcttgagcgagcacgacacgctggtaaaagtgttcgattaccggatacccggtccgtcgtgcgattgcccacatcagaaccggggcgtactgtgaccggtgaagccgtgaaaccataataatgacaagatcgagcaccgccccatggacagccatctgctgagtgatcgcagcagcgtgtttcgtcacgctgacccttacgccgtctccgactatgtcaaccagcacgtcggccagcacttcatcggcctgtccaggaccgcccatccgcaagccagtctcaatcaccgcaaacttgccgatctcgatctcgcacgcatcagttatggcggcagtgttcgcgtgacatcgccggcgctggaaaccgtttaccacctgcaagtcctgctgcaaggcaattgcctgtggcgcgggcacaaacacgagcagcatctggtgccgggcgaactgttgctgatcaacccggacgatccggtcgatctgacctactcggacgattgcgagaaattcattctcaaggtgccggtcagtgtccttgaaacagtgtgcgacgagcagcgctggatacgcccggcgagcggtattcgattcctgcgcaatcactatcagctgaatgagctggaaggtttcaccaacctgctggcaatggtctgccaggaagccgaggccagcgatccgttgttgcgggtgcaggagcattacgcgcagatcatcggcagcaaactgatttcgctgatgaacaccaacgtcagccgtgaatgcctgagctcacccaacatcagttttgaacgcatcctcgattacatcgaacgcaaccttaaacgcgacttgcccgccgaacatctggccgcgcaagccagcatgagcccgcgctcgctgtacaccttgttcgaacgccaactgggcgtcacgccgatgcaatacatccgccagcgcaagctcgaacgcatccacgcctgccttagcgacccgagttgcccggtgcgcaatctgactgaactggcactggattacggcttcctgcacctgggccgcttctccgaaagctatcgccaacagttcggcgaactgccgtcgcagaccttcaaacgccgccactgatacctcccttcgaaacacgctgaatcatctgccggaccatcctgcacaaaacggatagcggtctgcaggattcggctattgccccgcgcatcgcctccctaatctgacctggcctgaacaataacaatggaggccccggccatgtccctgggaatcgactacctcaatgccatgcttgaagaagaccaagagaagggcgcctaccgctgcaagcgggagatgttcaccgatccgcgtctgttcgaactggaaatggcgcacatcttcgaaggcaactggatttacctcgcccacgaaagccagctgcccaacaacaacgattttctcatcaccatcatggggcgccagccgatttttatcgcgcgcaacaaggacggtgtgctcaacgcttttctcaacgcctgcagccatcgcggcgccatgctgtgccggcacaagtccggcaaccgttccagctacacctgcccgtttcacggctggacgttcaacaacagcggcaaactgctcaaggtcaaagacccgagcgaagccggttacccgcaaggtttcaactgcgaaggctcccatgacctgaccaaagttgcgcggttcgaatcctatcggggttttctgttcggcagcctgaacgccgaggttaaatccctcgcggagcatctgggcgagtcggcgaaaatcatcgacatgatcgtcgaccagtcgccagaaggcctggaagtattgcgtggctccagctcctatatctacgaaggcaactggaaactcaccgccgaaaacggcgccgacggttaccacgtcagttcggtgcactggaactacgccgctacccagaaccagcgtcaacagcgcgaagcaggtgaggcgatcaagaccatgagcgctggcagttgggcgaagaagggcggcggtttctattccttcgatcacggccacctgctgctctggacccgctgggccaaccctgaagatcgtcccgcctatgagcgtcgcgacgaactggcccgtgatttcggtcaggcccgtgccgactggatgatcgagaactcacgcaacctgtgcctgtaccccaacgtgtacttgatggatcagttcagctcacagatccgtatcgcccggccgatctcggtcgacaagaccgaaatcaccatttactgcatcgctcccaaaggcgagagcgccgaggcgcgcgccaaacgtattcggcagtacgaagatttcttcaacgtcagcggcatggccacgccggatgatctggaagagtttcgttcgtgccagaccggctacggcgctggtcgtggctggaacgacatgtcccgtggcgccacccactgggttgaaggcgcggacgcagcggccgaagaaatcgacctcaaaccgctgctctccggcatgcgcaccgaagacgaaggcctgttcgtgctgcaacacaagtactggcaggaaaccatgctcaaagccgctgccagcgaaccacaactgatccctgtggaggccgtgtgatgagcaacctctacgacagcgtgcgcgattttctctaccgcgaagcgcgttatctcgatgacggccaatgggatcaatggctggaactgtacgccgccgacgcgactttctggatgccggcctgggacgataacgacacgctcaccgaagacccgcaaagcgaaatctcgctgatctggtacggcaaccgtggcggcctcgaagaccgcatcttccggatcaagaccgagcgctccagcgcgaccattcccgacacccgcacctcgcacaacctgagcaacatcgagatcgtcgagcacagcaccgaccagtgccaggtgcgcttcaactggcacaccctgagcttccgctaccaggtcaccgacagctacttcggcagcagtttctacaccctcgatctgcgtagcgaacagccgctgatcaaggccaagagagtcgtgctgaaaaacgattacgtccgtcaggtcatcgacatctaccacatctagtcgacacgacgaggtgcaccatgaatttccagattgcgcttaattttgaagacggcgtcacccgtttcatcgaggctggcggccatgaaaccgtggccgacgcggcgtaccgccaaggcatcaacattccgctggactgccgcgacggcgcctgcggcacctgcaaatgtttcgccgaagccgggcgttacgacatgggcgacaacttcatcgaagacgccttgagcgccgacgagcttgcgcaaggctatgtgctgacctgccagatgcgcgctgaaagcgattgcgtcgtgcgagtgccggcaggctcgcaggtgtgcaagaccgagcaggcgaacttccaggcctcgatcagcgatgtccggcaattgtcggagagcaccattgccttgtcgatcaagggcgaagcgctgagcaaactggcgttcctgccgggtcagtacgtcaacctgcaagtgcccggtagcgagcagagtcgcgcctactccttcagctcgttgcagaaggatggcgaggtcagctttctgattcgcaacgtgcccggcggcttgatgagcagcttcctcaccgggctggccaaggctggcgacagcatgaacctggccgggccgttgggcagtttttacctgcgggaaatcaagcggccactgctgttgctggccggcggcacgggcctggcgccgttcaccgcgatgctggagaaaatcgcggagcagggcagcgaacatcccgtgcatttgatctacggcgtgaccaatgatttcgatctggtcgagctcgaccgcctcgaagccttcgccgcgcgcatcagtcatttcagctttggtgcctgcgtggccaatccgcagagcgcgcacccgctcaagggctacgtcacccagcacatcgagccgcgccacctcaacgcaggcgacgtcgacgtgtacctgtgcgggccgccgccgatggttgaggcggtcagccaatacatccgcgagcagggcatcaccccggcgaatttctactacgaaaaattcgccgcagcggctgcctgaaccccaattttcgaggttgtcatgaacaacagattctccaacaaggtcgcgctggtcaccggcgcggcgcagggtatcggccgccgcgtgtgcgaacgcctgttgcgtgaaggtgcgcaagtggttgccgttgaccgctccgaactggttcacgagctgcaaggcgagggggttctggcgctgacggctgacctcgaacagtacgccgattgcgcccgggtcatggccgaggcgatcaacactttccgccgtctcgacatcctgatcaacaatgtcggcgggacgatctgggccaagccgttcgagcattaccaagtcgagcagatcgaagccgaggtgcgccgttcgctgttcccgaccctgtggtgctgccatgcggcgttgccgtacatgctcaagcaagggcgcggcgccatcgtcaacgtctcgtcgattgccacccgcagcgtcaatcgcgtgccgtacggcgcggccaagggtggcatcaacgcactcaccgcgtgcctggccttcgaaaacgccgagcgtggcattcgggtcaacgccaccgcaccgggcggcaccgaagctccgccgcgacgcatcccgcgtaatgccggcgaacagtcggcgcaggagcaggcctggtatcaggagatcgtcgcgcaaaccctcgacagcagcctgatgaaacgctacggcagcctcgatgaacaggtcggcgcgatcctctttctcgcctccgacgacgcctcgtacatcaccggtgtgaccttgccggtcggtggcggcgacctcggttgatcactctgtaaaggacacagacatgcagcgaattctgattgaaagcctgtcgacgatcatcgtcgacttgccgaccatccgcccgcacaaactggcgatgcacacgatgcagaagcagagcctggtgattctgcgcctgcgttgcagcgatggcattgaaggtatcggcgaagccaccaccattggcggtcttgcttacggttatgaaagcccggaaagcatcaaagccaatatcgacgcgcatctggccccggcgctggtgggcatggaagcgaacaacatcaacgcggcgatgcagcggctcgacaagatcgccaagggcaatactttcgccaagtccggcatcgaaagcgcactgctcgatgcccaaggcaagcgcctcggtctgccggtcagcgagctgctcggcggccgcgtacgtgacagccttgaagtggcctggaccttggccagcggcgacaccgcccgcgacatcgccgaggccgaacagatgctcgaggcgcgccgccatcgcatcttcaaactgaagatcggcgccaacccgctggaacaggatctcaaacacgtcgtggcgatcaaaaaggccttgggcgagcgcgccagtgtgcgcgtcgacgtcaaccagtattgggacgagtcccaggcaattcgcggctgtcaggtgctcggtgacaacggcatcgacctgattgagcagccgatctcgcgggtcaatcgttccggacagattcgtctgaaccagcgcagcccggcaccgatcatggccgatgaatcgatcgaaagtgtcgaggacgccttcagcctcgccgccgacggcgccgccagtgtcttcgccctgaagatcgccaagaacggtggcccgcgcgccgtgctcagaaccgcacaaatcgccgaagccgccggcatcgcgttgtacggcggcaccatgctcgaaggctccatcggcacgctggcctcggcgcacgccttcctcacgatcaggcaactgacctgggacaccgaactgttcggcccattgttgctgactgaagacatcgtcaccgaaacgccgcagtaccgcgattttcatctgcacatcccgcgaactccaggcctgggcctgacgctggatgaagagcgtctggcgcgttttcgccgccactgaatcaggagagccaccatgctgttccacgtaaaaatgaccgtgaaattgcccgtcgatatggacccgtcactggccacccggctcaaggctgacgagaaggaaatggcgcaacggctgcaacgcgaaggcgtatggcggcacctgtggcgcatcgccgggcactacgccaattacagcgtgttcgacgtgccgagcgtcgaggcactgcacgacacgctgatgcgcttgccgttgttcccttacatggatatcgaggtcgatggcctctgccggcatccgtcgtcgatccacagcgacgatcgctgacccaacccggtccctgtaggagtgagcctgctcgcgatagcggtgtgtcattcggcatcaatagtgactgatccaccgcattcgcgagcaggctcgctcccacaggggattggggggagccaagaaactgcgccaacaaaacaacaagataaggtaaccaccatgaccgtgaaaattgcccacaccgccgagttgcaagccttcttcaaagaagccgccggttttgccaacgacgagggtaattcccgtctgaaaaccatcgtcctgcgcattttgcaggacaccgcgacaatcatcgaagacctcgacatcagcgaggacgagttctggaaagccgtcgattatctcaaccgcctgggcggtcgctcagaggccgggttactggtcgcagggctgggtatcgaacactttctcgacctgttgcaggacgccaaggacgcgcagatcggtttgaccggcggcacgccgcgcaccatcgaagggccgctgtatgtggccggagcacccctgtgcgaaggcgaatgccgcatggatgatggcagcgaggagggcatcgccaccgtgatgcgcctcgaaggccaggtgttcgatcttcacggccaaccgttggccggtgccacggttgacctgtggcacgccaacaccaagggcacttactcgtttttcgacccgagccagtccgagtacaacctgcgtcgacgcatcatcaccgacgccgaaggccgttaccgcgcgcgcagcatcgtgccgtccggatatggctgcgacccgcaaggcccgacccaggaatgcctgaacctgcttggtcgccatggccagcgtccggcccatgtgcactttttcatcagcgccccggggcatcggcatctgacgacgcagatcaatctgtcgggcgaccaatatctgtgggacgactttgcttatgcgacccgtgaagggctggtcggggaagtgctgttccacgaggacgacgtctctggacgccatgccgagctgaagttcgactttcagctgcaaccggcgccggatgccagtgccgaacaacgcagccaacgcccacgtgcattgcaggacgcttgataccgagtcgtcagtgcccctcaccctaaccctctcccagagggagaggggactgaccgggggatcttgagtgctacgccgacctgaacgatatttgccgaatccaacccggttgttcaggtcgatgcataccgcaagacaacacggtcggctccctctcccccgggagagggctggggtgaggggagtgaccgaagggatcttgagtgctacgtcgacctgaacgatatttgccgaatccaacccggttgttcaggtcgatgcataccgcaagacaacacggtcggctccctctccttcgggagagggctggggtgaggggaaatcagacctaaggtaatgcgaaaaagatattggctacgtatttttaagatcgtttagttttgtcgcaacgacgaaccaaaacgcatcaaaccgacagaccccgattgccatgacggcacacgctgaatcgatcacaggctcttcaggtttgattcacacgggagtgaatcatgccgcatacccttgacatcaccgcattaccgacccttgatctgtccttgttcgaaggcacggcgcagcagcgttacgcgtttctcgatgacttgcgccaggcggcccgcgacgttgggttcttctatctgaccggccatggcatcgactctgctttgctcaagcaagtgcaagaacacgctcgccagtttttcgccttgcctgacagcgccaaagcagcggtcggcatgatcaactcgccgcactttcgcggttacaaccgtgctgcctccgagatcacccgtggccaacccgactggcgcgaacagttcgatctgggcgccgagcgcgaggccttgccaatacaagcggacagcccgttctgggcgcggctgcaagggcccaaccagtggccggcggcattgccggaattgaaacccttgttgcttgaatggcagcaggcgatgacgcacatgtccctgcgtttactgcgcgccttcgctcaggccttgtcgctgcgtgccgatgctttcgatcagctctacggcgaccgacccaacgaacacatcaagctgatgcgctatcccggtcagtcgcgcgaggcgagccatcaaggcgtcggcgcgcacaaggattccgggttcttgagtttcctgttgcaagaccagcaggccggtctgcaagtcgagatcgaagagggccgctggatcgatgcgctgccacgggagaacacgctggtggtgaacatcggcgaactgctcgaactcgcttccaacggctatttgcgtgccacggtgcatcgcgtcgtgtcgccgccgcagggtagcgaacgcctgtccatcgcgttcttcctcggcgcacaactcgacgccacggtgccgctgtacccattgcccaccgcgctgctacgcgaggcgcgcgggccggcgagtgatccgctcaatccactgtttcgcgacgtcggctcgaattacctcaagggacgtctgcgctcgcaccccgatgtcgcgcaacgcttctatgccgacgcgctgctgccaccagcgccagtgcgcaaaaccgcctgattcatcactcgctcaaggattatcgatatgttgaaacaagccggtttgaccctcgccgtgctcggcacactggtgacgtcattcagtgctcaggcactggaaccgttgcgcgtcgccgccgacccggtgcctcacgcgcagatccttgcgtacatccagaaaatcgatccgcaactcaacctcaaggtcatcgaaatccccaacggtgtgaactccaatgagctgttggtgcacggtgatgtcgacgccaattacttccagcatttgccctatctgaaatcccaggagcaggcgctcggcgagaaacttgcggtggccgccaccgtgcatatcgaacccttgggcatttactcgcgtcgccacaaaagcttcgctgacgtgccgaataaaggcaccgtcgctgtaccgaacaacgtcaccaacctgagccgcgcgctgtacctgttgcaagacaatggcttgatcaaactcaaacccggtttcaacgatccggccactgatcaggcaacaccgaaagacatcgccgaaaacccgaaacagctgaagattctcgaaatcgaatcaccgcagatcccgcgctcgctagacgatgtcgatctggcggtgatcaacggcaactacgcgctcgacgcaggcctggtgccggccaaggatgccttgggcctggagaaagccgagcacaatccctacgcgaatattctggtgaccaccccgaaactgcagaacgacccacgtatcgcgcaactggccaaggatctgacttcgccgcaagtcgccaggtacatcaccgatcactttgccggttcggtgattccagtggcaggcagccagccatgatcaccgtcgagcaattgagcaaaacctatccgtcagcggcgcaaccggcactggatcaggtatcgctgagcattcccgacggcgcggtctatgggattctcgggcgcagcggcgcgggcaagtcgacgctgttgcgttgcctcaatctgctcgaacgtcccgacagcggacggattctgctcgatggcgtcgacctgatgaagctgtccgccagcgatctgcgccagcaacgccagcgcatcggtatgatctttcaaggcttcaacctgctgcattcacgcacggtcttcgacaacattgccgtaccgctggagatcgccaatgtcggcaaaccgtggcgtcacgtgcgggtacgcgagctgctggaactggtcggtttgactgacaaggcgcaggcgtttccttcgcaattgtccggtggccagaaacagcgcgtgggcattgcccgtgcgctggcggcggagccggcatatttgttgtcggacgaagcgaccagtgccctcgacccggaaaccaccgcatcgattctggaactgttgcgtgacatcaatcggcaactggggttgaccattgtgctgatcacccatgaactcgacgtggtcaaatcgatctgcgatcacgcggcgttcatggccaacgggcggatggtggaggctgggccggtgccgcgtctgatggctgatccacaatcgagcctgggcagttcgttgcgcccgacttgcggattaccgctggggcatgcggcccccggcctgagttttctcaaacagtacggcgtgcgggcagcacaatcatgaatcgctcaatcgactggtatgaaatcctgcaactggtgctcaacgccaccggtgaaaccctgtacatggtcctgctcgccgggttgttcacgctgctgatcggtttgccgctgggcgtgttgctgtttatcagccgccgcggtgggctttacccgatgccacggctgaataccgcgttgagtgcactggtcaacctcggccgttcgctgccgttcgtggtgatgctgattgccctgattccactgacccgactagtggtcggcacgaccctgggcagcaccgccgccgtagtgccgatcaccattggcgcgtttccattcttcgcgcgcatcgtcgaaaacgcgctggacgaagtcgacaagggccgcatcgaagcaatcctcgccatgggcggcgacatcggccatgtgatcttcaaagtgctgttgcccgaagcgctgccggcgttgctggctgggatcaccttgacgctggtgatgctgatcggtttttcctcgatggccggggtgatcggtggcggcgggctcggcgatctggcgatccgttacggctatcagcgcttcaacaatgaagtcatggttgccactgtcgtggtgttggtcatcctcgttcaaggcgtgcagagcctgggtgatcgattggtgcgttcgctggctcatcgccgctaaggaattttatgagtgcgcctgtcgccgtggcccgcgagccgctgattcgtgtgcgtgagctgagcaaatcctttgcttcgaaccgcgcgctggatcgcgtcagtctggatatttatcccgccgaagtggtggccttgctcggtgccaatggcgcgggcaagtcgactctggtgaagatcctggcgggcagtcagactgccgatgccggcgagatcagcgtcgagggtcagaatctctgtttcaactcgccgttgtctgcgcgccgggtcgggattgtcgcggtgcatcagcagatcaacgatggcatcgccccaggtttgagcgtggccgagaacctgctgctcgatgagttgtgcaagccggacgcggacttctggctcaatcgtaaacgcctgcttgcgcgcgctgcgaacattgctgccggcctcggtctgaccttgccgctggagcaaccgatcgaacatttggggcaggccgagcgccaattggtggtgctggcgcgggcctttgccctgcagccgcgcctgctgattctcgatgagccgacggcggcgctctccgatgccgaggcgcagcgcctgttcgccttgatcgacaccttgcgtagtcgtcgggtggcgattgtgtacatctcccatcgactgtccgacctgcaacgcgtggccgaccgcgccatcgtcctgcgtgatggccagttcgcgggcgagttcacggcacggcaattacccgacgcggtgagcgccatgctcgggcaggcgctggccgagcatgtttacctgccacgcgtggccgggcgcgaagtgttgaaactcaacgccatgcaaattctgccgcgctccgccgcgttcgatctgagcctgcacgagaatgaagtggtggtgctgaccgggctgttgggttccggtaaaagtgaaatcgcccaggtgctgttcggcctgcgtgaagcgacctcgggccgcgtgcaactggatggtgctgactggcgtgcggactcaccgcgccaggccatccaaagcggggttttcttcgcggccgaggatcgcggcagtcaatcgctggtacccgatttcactttgcgtcgcaccctgactttgccgtttctcgagcgctttacccgcggcggtttcatccgcaaccgcgccgaagcggcagcggtcgaggcgcaagtggtggcgctggggatcaagaccaccggcatcgatgtgcccatgagcgctttgtccggcggcaatcagcagaaagtcgttctcggccgctggctgctcggcgaagggcgggtgttgatccttgatgaaccctttcaaggcgtcgacgtgcgcgcccgccgcgacatcggccaactgctgcgcgacagcgccgaggggcgcgcgactttagtgatttgcgccgacgtcgatgaagccctggaaattgccgaccgcattctgctggtgcgcgatcacgcggtggtcgccgagtacccgcgtgccggcctcaatcgtgccgatctggtcgccgcactggccggcagcgacgtgaccgaacattcccctcaagccacgccaaggagcagagcgagtgcctgattcaagttccctgttatcgacccatgtggcgcccgccgaacgcttgctgcaagccttgattcgctatggcctgttatggctgctggcgctgatcgtggtgtttttcagcgttgccgaaccagcgtttctgcgggtcggcaacctgttcagcatcctgcaatcggtgtcgattgtcgcgctgctggcgctgggtgtgacgttgaccatggcggtcggcggcctcgacctgtcgattggcgcggtggcggcgatgagcctgatgattgccagttacgtgatggtcgtgctcggctggggcgcggtgccggcggtgttgatcagccttgccggcggtgcgctggtcgggctgctcaacggttggctgatcgtcaaattgcgcgtgccggacattctcgcaacgctcggcagcatgtttctggtgatcggtgtgcaactgattcccacgggcggacgctcgattgccgtcggcatgaccttgcccagcggcgaagaaaccgagggcaccttcagcgctgcgtttctcgcgttggggcgcgggcggttgtgggaggtggtgccgattccggtgttgatcactgccgtggttgcgctggcggtgtggctgtttctagaacgtacgcgcattggccgtctgttctatgccatcggtggcaacgagcaggcggcgcggcttgccggtgcgccggtgcagcgcttcaagttgttggcctacgtgctctcggcggtgctggcgtcactgggcggtgtgttgctcgcggcgcggctggggcgcggtgatgtcagttccggcaacggtctggtgctcgacgcgttgggggcagctctgatcggttttgccgtgctcggcgcaaagaagcccaatgcgttcggcacgttgatcggtgcgctgctggtggcgtcgctgctcaatggcctgaccatgctcaacgcgccgtattacgcgcaggatttcgtcaagggactggtgttggtgctggccctgatgttcaccttcggcctcgcgcatcgggcgcgctgagccgcattcattcaaggaagtgctatgcacggttcaatcaaacagttcgttgccggtgcgttgctctcggccatggccctgagtgttcaggcacaggcattgcccggtgcaccggcaccgttcgataaaggtcaggtgcagatcgcgttggtgggttacctgttttccggggattttcccgaggcgtatttgcgcggtgtagagcaacagactgaagcgctgggcgcccatttgcgggtgttcgatgcgcggcagcaagcggcgagtcagggcgagatgatcgatcaggcgattgatctgggcgtcgacggcatcatcgtccagctcgggctcgccgaaacgctgaaagcgccgattgaccgggccattgccaaaggcatcaaagtcgtcgccttcgacgttgacctgaacacgccgcaagtgactcaggtcgagcaggatcaccacgctttggcacgcctggcactggatcaggcggtgaaggacaacggcacgcgtttcgatgctggctacgtctacatcagcggcttcacgccgatggagcggcgcgacgagatctggagccaagtgaagcaagccaatccggggatcatcgaaaaggcccgtttcggcacgctgaacccgccgattgccaattcagtggccgatcaggccagtgcggtgctccgggcgaatccggggatcagcgtgatctttgcgccgttcgatgaattcgccaaaggcgcgaaaatcgccgtggatgaagcgggtttggcgagcaaagtgaggatctacagcgcggacatttccaccgccgatatccagatcatgaaagagccggacagcgcctgggccgcgacagcggcggtcaatccgcaagtggccggggcgatcagcgtacgcagtctggcgatgttgattgccggggaaaatcctgggcatcaggtgctggtgccgccaacgttgattacccgtcagcaactgctggatctggacgtgaaaaacgttcgagatctggcgcagaaactcccggccttcggtgataccgccaacgtcgcgcgggcaccgtggattccggtggtcaactagaacatttgccacgacatcgcccatgtgggagcgagcctgctcgcgaagaggtctgatcagttgatatctctggtgactgacccaccgctttcgcgagcaggctcgctcccacaggggtaacgcgtagttgcgcaaactgagggagttctggagcttacatgcacaacaaagctgcacgcctacacaaaagccgttccccggcagcggatccgttgttcggtaatcgactgcccccaggccaagtgctgacggagcgatttccaatcctgcacgaaggcgaaatacccgaatacgacctcgcccattggtcgttgcggctgttcggcacgctcgcccgaccgatcgaattgcgttacgccgatctgcaggcactgccacaacggcaactgcgctgcgacatccattgcgtgacacgctggtcgaagttcgacaccgagtggagcgggatacatctgcaggatctgttgcaggctttcaatctccagccgacatcggcgttcgtcatggctcatgccgaccacgattaccagaccaacttgcgactcgatgatttacttcacccggccagcctgttggccactcattacaacggccagcccttgaccgcccaacacggctggccgttgcgccttgtggtcgccgggcggtatttctggaagagcgcgaagtggttgcgcggtctggaatttgttaacgaggagcaaccggggttttgggagcgcaatggctttcatctgcacgccgatccgtttgccgaacagcgcttcagtggtgatgaactggatattgccgaggatgcctggctggaaaaagagttcgactaagtagcgtctgatgcaaatcaaaactgtaggagtgagcctgctcgcgatagcggttttaaattcaacggtgatgtcgacagatgtaccgctatcgcgagcaggctcactcttacaggggactgtatttcagtctgaaatagtgtttttagttggttcaagtgttggctaagcaacatctctgttgaactaagaacaatcctttagagcgatctaacctaagcgttattggttcttttacgaccgctggcagctcgtctagcatcggctttcaaggggaaacgtctcagctggggaaactgcaactcaccgtaaaaaaccttcactgccttccagaaatccaaaactacagcagacattgccgcgcattgcttgccgaactttattgtcggcaacggccgggtgttaactgcgattcaaggagctgtcatatgtattaccgttcccgttcattactggcggccgctgtcgtgtccgccatttggcaacttccggccaacgccgaagaaacttcggcaagtgctgacagcgaatcgcgactcggcaccgtgttggtcaccggcacccgtggcacttcacgcaccgtgctcgattcgccggtgccggtcgatgtactcaccgctgaagacctgaaaaccgccggcgccgctgatggcgaactgggtgcagccttgcagacgctgttgccgtccttcagtctgccgcgccaatccaactccggcggtgccgaccatgtccgtgctgcgcaattgcgcggcatgagcccggatcaggtgttggtattggtcaatggcaagcgccgccacacctcggcggtggtcaacgactcgtcgaaaatcggtcgtggcaccgcgccggtggatttcaactcgattcccatcagtgccatcaaacgtatcgaagtgctgcgcgacggcgcaggtgcgcaatacggctccgacgccatcgccggggtgatcaacatcatcctcgacgacgcgcccgagggtggtgaagtgtcgaccagttacggcgcctatcacacgcaccaggacgccatcggcaagaccaccaccgacggccagaacagcgtgaccaccgcgaagatcggcacacggcttggcgaggagggcggcttcattcgcggcggcaccgagtacaaggatcgcaacccgaccaaccgcgccggttttgatggctttgccgataccccgaaccagcgcaactacgtgatgggcgacggcctcgcccgcgacgtcaacctgtggttcaacagtgagctgccgttggcgggcggcaaggcctacagcttcggtacctacaaccagcgtcacaccaccggcgccgagttctatcgctatccgtacgagcaaccgcagttctaccccaacggctacttgccgcaatcgctcggcgacaacaaggatgtttccgccacggcgggcttcaaaggcatgatcggcgacgactgggacttcgacagcagcgtcacccatggccgcaaccgcttcgatggatcgacccggcgcaccctcaatgtcagcctcggtgaagactcgccgacgaaattcgataccggcgactacgaactgcgccagaccagcagcaacctcgatttcagccgtgaattgcgcctcggtggacgctcgttcgtgctggcagtcggcggtgagtatcgctacgaaaattacctgacctacgccggcgacgaggcttcctacatcggctctggtgccgatggcgccaatggcttgcggccgagtgaagaatcggatctggaccgcaatgtgttcggcacttatgccgagttgtccggcgaccttaccgaccgcttcttcgtcgacggcgccacgcgctgggaacattacgatgacgctggcagcaagctcaccggcaaactcagtggccgctacaaactgaccgatcagtgggcattgcgcggtgcggtctcgaacaacttccgcgcaccatcgctggcgcaaagcggcttccagaacaccaccagcaacttcggcgatggcggtacgctgaccgatattcgcgtgctctcggtcaacgatccgatcgcccgtgcactgggcgcggaaaagctcgatccggaaacctcgaaaaacttcagcctcggcctgaccttccagctgaacgaacgcttcgacgcctcgctggacgtgttccgcatcgacgtcaaagaccgcattaccctgtcacaacgcattggcagcgatgccctggaaagctacatcaatgacaacttcggcgtagcgggagtgcacgacgtcaacttcttcaccaacgccgctgacacccgcacccacggcgccgaactggtgctcaactatcatcagccgttctatgacgggcaattgggcctgaccaccgcgtatacctataaccacaccaaagtcaccagcaccaaaggcacgccatcgcaactgacggcgttgggcatcggcaattacgcactggttggcgtcgaagaaaccaacaccctgaccgacgccgcgccgaaggaccgcttcatcttttccgctaactgggccagcgagcattggggtttgctcgggcgcctgacgcgtcagggcgagaccacccgcgtgttcgatttcggcgattcgcaaccagagcaaacctacggtgcggtgtggcaactggacgccgaggttgcctataaattcaccccgaaattcaacatcgccgtgggtggcaacaaccttaccgacaactacccggaacgctccggctcggcgatcaactacggcggcaacctgccgtatgacgtgctctcgccgatcggcaccaacggcgcctactactacgcccgcgccacttatggtttctaacgcggggccggggcggcatctgccggtgtttcaggcgttattgatcacgctgggcatggtgatcactaccgacatcctgaaaaccgcgccgaccgtggcacttaacgtcgcgccagaacatttctacctggtgtgggggctcggcggtgtggcgtcgatgatcggcgcgctgtgttttgccgagatggccacggcatttccgcacccgggcggcgactatcattttttgcgcacggcttacggtgaacgcatgggattactgttcgcctggtcgcggttttcggtgatgcacaccggatggatcgcgttgtcggcattcatgtttgccgattacttcaacgcggtagttccgctggggcagtacggctcggggttgtttgccggggcgatcattgccgccctggtgctgctcaatctctcgggcaagcacattggtttcatcactcaggcgttgttggttggcttgctcgcgttgggttttctgagcattgccagcgccggtgtctggctgcagtggcagggcatcgaaccaccggtagcggacgtttcggtcacgccgcagcacaccggtatggccggattttcggcggcgatgattttcgtgttcctggccttcggtggctggagcgatgcggcaacattatcggcagaagtgcgcgacggtcgacggggcatcttcatcgccatgatcggagcgctggcggtgctgatgagcatctatctggcgctcaattgggcgttcgtcgcaggtttgggattcgccggactggcggcgagcaacgcgccggcggttgagctgctgaaccgcgcgttcggcgcacccggggtcatgctgattctattgatggtcggtatcgccgccatcgccagcattaactcgaccctgttggtcggcgcccggactacctacgctgccgcccgtgatgtgccgcaactgcgcagtttcggtgactgggacgaccgtcacggcgtgccgcgcaaagccttgctcgcggaaggcgcggtggcgttgctgttggtgttgttcggcagttttacccagagtggtttcaacactatggttgagtatttgactccggtgtactggctgtttttgagcttgagcagcgtcgcgttgatcattctgcggcggcgctttcccgacgtgccgaggccggtgcgggtgccgttgtatccgctgttgccgctgctgtttttcgggttgtgcctgtacatgctgtattccagcgtgacaatggtcggctatggcgcgtttctggggattgctgtgttgctggtgggggcgctgattctggcggggttgagccgcgtggcgtcgacgcctcggcaagctcttgggcagatatcggactagaacgacacctcggccggttgcgacaaacgcagcaccgacaggtcgccggtgatgcgtttgtacgccaggcgaatcgcttcgatgtcacgggaacgctgcacgctgttctcatgcaggatcacaatgaccttggtgctcaagcgctcaggctcttttgcgcctttatcgcgccattgaccatacgcgtcgagcacactgaagccatcggggaagcgcggtgtgacttccctgtcgagaaattcgcgccagcgcgccgggctgacgagaccttccttgccatcgatcgaacccaccgaaaagtacagctcggtgcgcagccattgcgcctgcgccggccgcgcggcatcgccttgcagcgtcgaactggcgggatcatgggtgtgaacggaagcgggaggagggctggcacaaccggcgactgcgaggaacagtgccgccagtaaaagacgttgaggcatggaacatccttattgaacggtgggtgaaccgctgaagtataaggctgccgttcgaccgtcaataaagacctgaaaagcaggcagtcaggcgtttcgggaataacccgaaacgcctgcggcactcactcgaccacttcgatcttgaattcgccatagctgcgattctgggtgaggtcgatcggcacgaacatcccgtacgcctgcaaataggcatacatcgcagtgctttcaccgtagcggtagtgcctgcctgtacaagtgatgactttggcgctgcccgtcaacgatggaaagaacgcactggcaggcttttgtgcttccacggcgcagtcaaaccttgtgtcctccggttctggggctttctggaagcgggggctggatctttgttcggtgtagctcagaagcgcaccgacaggcatgttcgtccagtcaccggtgaatcgcaggtcggtaatcgcgttttttttcacggtgatcccgtaacggtcagtacggtaatcgatgtcggccaggtcgatcagacctcggaaagtgatgttgaccgattgatggtttttatcgttgtagcgttctgtaagctgcttgcccggctcgtatccaaggtagcggcggtccctgcccaaacgtcccagcgccagacgctcggggttgttcgagagcaggtacgacatgcccgcctcctgaaactgcctgcgccgatcagcctcgtttgggtctttgaagatcacgcgcaagcgttgaatgttgttttccgggaccggcaatttcaacgcttcaatggatttcgtcacagaggcaggcaggactggatcagccaatatgaatggcgtttgctctcggccggagaaaggtttcagtgccgccaacacctgcggtgtggcacatgcggttgccagcagttgacggttgtcggcgtccagagttttctcggcgacggcgtcaacgctgatcgcgccggctatcacgcggctttgcttatcaacgtagaaggtactgagcgaggtcaattgttgtttagcgcaatcagcgctccagcgcatacgcttctgcgcatacaggccattttcgcggggcagaagcgtttcgcctgcgggtacccgggcggaccagaagaatatctggccgtctttttgattcaggctggcacgatcaatcagctgccattcctgtaactccggcgccgaaatgacccgccattgtgccaccggtgtctgagcacaaacctgtttgaattgaggactctgcagaaacagttttttctgttcggcaggcatttgcttgtcttcgtttgcgccactgtttcgaacagccacaaactgaagcatgcccttgttggtcaaatgcgccatttgtgcatcgggcagatgacagtcggcgttgaagttcgccagttgaagtattcgccgcccctcagtcgccatcacgtaatagctgacgtgatcgccatcgcgcacgatggtattcgggtcgggttgagcgagcatcgcctcatcaaacgcgatccgccccagcgcttcgagatcggcactcgtctgtttggggggcggggggctctggcatccgtagagggcgagggcaagcaaagacaaacaactgaaacggcggatcaaggcatccatgcggagggcacactgtcggattaaaagtgatggcacattaacatttcggcagtgacgacaaagactttaccctgccatcgccaacaggctctccaatacaccgcatagcctgcaggagctatcgagtgcaacgaggctgcgatcttttgatcctgttttttaagatcaagatcaaaagatcgcggtgtgccgctgctcctgcggggggtgtcagggactgctgggtgggggagtggcgagggcgattcccgctgcgccaaggcgcttgagaatctcgaacagcaagtcactcttggtcaccccgacgatcctcgggctgccgacatagccggtcaccgtcagagtaataccgtccggcgacaacttgctgaaacgcacgaacgacgcgggtttatcgaggatggtttcgttctcgcgataggtgttgagcagcaggtccttgacctcttcggggtcgatgtccagcgggaacatcaactccagcgacgccacaccctgagcgctgccacccagcgtaacgttgcgcaggttctgcgagatcagttgcgagttcggcacgatcacgatcgagcggtcgctgagctggatttccgtggcacgcacgttgatccggcggatgtcgccctcgacgccgctgatgctgatcagatcgccgaccttcaccgggcgctcggtcagcagaatcaggccggaaacgaagttcttcacgatctcctgcaaaccgaaaccgatgcccaccgacagcgcactgacgatccacgccaggttggtccattgcacgcccagcgaagacagggtcatgaggatcacaaaggcataaccgatattggaaaacagcgtgctgagcgatgcacacatgcccgggtccatgtcggtcttgggcaggaactcgttgtcgagccagcggcgcagggcgcggatcagccagatgccgatcatcagcgccaacactgcgttgagcagatgcgccgggacgatattgaacttgcgcaagccggcgccgccgaggatcgccatgatattggtcgccaactgcccgagcgtggtgccaatgccgccgacaaacagcgcgatcaccgctagcagcaacagcgctgcgcggctgaacccggacaacagaatcgagatctgctcgagccgtcgatcactggttcccagcaactgtttgagcgccttgccactggcgtgtttgggcgaaaatacgtgctcgcagctgtccttgatgacctggatcagcaagtagaaacccgacagcacgatgtaggcccagaccacttcataggtgatgaaccggctcagcgagatatagccagtgagcagggcaatcgccgagaccaacatcgaaatactggcgatggtgtacaccacgccggagaacgtactgccggtggccgaggcatcgttcgcggcgaccaatgccttgcgcaccttgcccacgcgcagcagcaacgacacgacaatcaccatgaccacaatcgagatgacgccgcgcccggccacgacaatctgactgctcatgccggtagagttgctcacctgcaccagcgtcaccagcaccagcagcgtgcccgacagaatgcgcggatacggcttcatcgccagcgccacggggtcggcaatcgccggcaaccgccatgacggatgctgggtggacaacaacgcgcggctcaggccggtgatcagcacacaggcataaacggctttttcgaactcctcggaaaatgtctccagcaccggcgtcaacggctcgtgacgcgtgcaggcatagaacagcaattgcagggcgaggccggtggtaacaattgtcgccagcgccgaagcgaacgccagcgcactacgacgcaaacgcccctccggcatgcgatgaatgcatacccacgtcagcccgcgctcagccagtcggcgcccgaacgtccagataaccagcgccagcaacaccaggaaactggtatagaaacgctgccccggcgcccagaccgtggcccaggtttcgctgacctgggcgacgaaaaaacgccaacgctgacgatcatcttgcgttggattgaccagcggcgaccagaagtccgggctcaacacactgtgggtgcccagcgtcagctcgctctcgagcaacgtgcgacggataccggcgatctgcgtaatcagctccgccgcgctttgcttgagcgccgccagactcttcagcgacgcatcgattttgttcttctgttccgccaacgacgcccggtgcgcaacgatatccgcctgttcggcggccacctcggtcgctggcgccgcgcccaacacactcaactgcacggccagctgcgcctgctgcggcagcaacgccgccgacaatttatcgacatcgagaatgaacgcctgcacccgatcctgcgggccttcgagctggttgtaattgtttgccgaggaaatttgttgcttgagaccgtcgaggcgctgctgcaaggcttgcaggtcgttttgtgaaatcaccggcagcggggcgacagcggccaccgaaggcgcaggcaattcggctgcccacagcaccggactgctgcagatgagcaagacgaatagcactgaaaacaacgacttcaagctgttgcgcatgggactggccgactctcgatggacacacagtctatgaggttaggtgatcaggccggatggggcggaaaagtttcaggaccggtgttgtctggatcagtaaaacccggcccttcaacatgatagacagtcggttcttcggaaaaatgttcctccagtccgagcatgaacaaccgatggtcttcgctcgcttcaaaacccggggtgtgatcctcaagtgatcgccagcgcacgatcaggttgaagacttcgggcgtttcgatcccctgtgcgaacacgtggccgaggtaacccttggcgcgagtgagcaacggcgccacttcagcaaacgcgtgtgtgaaacgttcaatgcattctttatgaacggggagtacagcgatctcgtaaatcatggtgtacctcaggaaggaatgcgcgggttgaaagtccgtgcttacgcgatcagggatggctcgacagcgattgcgatttttcctcgaatgccgttattcggactttccagccgtgcgtgggcgagccccaggtcggccagcgcataaacggcacccacatgggggcgtagttggccgcgcgcgaccaatgcggccaactcatcaagcttgccgcgattttgtcgggtgaaaacgaagtgatagctggcgttcctgccccaggcctgtacgaggttctgcggttgggcaatgtcgacaatcgtcaccacgcggccaagttgcgcgagcgcgtcggggctgcgcgacaaagtgttgccaccgatggtatcgaacacgacatcgactccctggcctgcggtttcgcgcatgatgacgtcgacgtaatcctctttctcgtagtcgatgaccacgtcggcgcccatgcttcttgcaaactcagcgttggcttcgcgcacggtcgtgaacactttcgcgcccatcgctttcgccaactggattgccacgtggccaacgccacccgcgccgccgtgcacgaggatggtttctcccacctgcagcgccgcacgcccgaccagcgcttcccacgctgtgccgcccaccagcgtcaggctcgccgcttcgagatggcttagcgatggcggcttcctgccaataatgctttcagccgcaacgtggtactcggcataacttcccggcccgtcaaatatttgcggcgtgtaccagacctcatcgcccgcagcgaacgccatcacacccggcccgaccgcttcgacaaccccggatacgtcatggccggtaatggccggtagtggcaccagatcggggtagtcgccacggcggacctggtaatccaacgggttgatagaggttgcatgcacccgcaccagcacctgtccggcctgcggtacgggcttgggaacgtcgcaaagttcgaacgattccggaccgccaaatgatttaagcaccatcgctttcattgtagttcctcatatctataaaaagggatatcgagatatctcgatatgttgtggtaaaaaattacagctcttttcctacgatctcggccaaggcactgatggttgcttcattgcgcttgtagtaggtccactgaccgatacgccggacttccaccaggcccactcgctgcagtgtcgccagataaccagacaccgttgactgcgacagcccgataccttcctgaatactgctgacgcagacgcccaccgtgagaacgtcaccttcatcctgtggcgggaagttctttgcgggatccttcagccccttcagaatttgaaggcgcgtagggttggagagggctttgaagatttcgagtaggtccatgtcgctgaggatatcgagatttaccgatatgtcaatacaagtattcgtagcttagattggagccggtaccgacacgatgttgcttgcgagatacaacggcacccagcagatagctcgtagtaactgccgccgaacgaacagaaaattcagcttttgggtgtcgtagcaaacgaatccttctacgctcaaacgatccagcggaaggacttgccagaatggattacctgattcgcaccgcgaccccggcggatgcttcggcgatcagccggaccatcatcaatacccttcgccagtccaacgcgctggactactcatccgacatcattgatcaggttgagcaaagtttttcaccacgggcggttctggatttgctggcccggcgtcaggtactcgtaaccacggtcgacaatcacatcgtggcaacggcgagccttgatcacgacgtggttcgcagcgtgttcgtcgacccacgacatcaggggcaaggtataggcagacacctgatggagcagattcaaacagttgccttgagcgcaggtatcgactcgctgcgtgttccctcatccattaccgccgaaggtttttatgcagcacttggcttcaagaaagtccgggatgaataccatcaggcggagcgcacgatcatcatggcgaaggcgctggaacagtagaaaagtcatcatggaatctaggcaatcgtccgtaggccgccgcgccgaaaaaccttcagggcagaagatggatgagttgcggttccagagcatctgcgcccatgtcgagcagggcgagggtgaccggaagtttgaaacgccgacgcccggcgctgcctgggtttatgtagagccgatcgccgcgccattcgatcaagggcttgtgggaatggccggtgatgatcagtttgatggagctgtcgaggagggcggcgacgtcggcaatgtcgtgggtcagcagggctggccagccattgaggtcgagaatgaggtggtccgggaggtcggcggcccaagaaaggtttaaatcattgttgccccgcaccgcctttaccggcgcgacttcggccagttgcgcgaggatttcggcggcaccgatgtcgccggcgtggatgatcagttcggcaccctgaacggcgttcagggcttcggggcggaggaggccgtgggtgtcggagatgatggctattttcatggggcagagattagcagggttggtctgcatggcagcgttcagccagtgaacatggaccttgataagagataccgccggtatactgctcgatcaaacagacgcgcacgttgccgaggctatccgcgaccgggttaaacagcctgagatgccgctcccccgatgatcttccaaggaacttgcaatgcctgcaggcaaacgtgaactggcgcgcatggagcgccggctgatctccacgctgacggacgcgtgcgaaacagcaaaaactgaaatcaaaggcttcacctggctcacccacacggctgacctgagcgcactggctgaaaccctgaacgtgatctgggtgttcgaaaccctcgctgatagaaagctcgctcaggttgaggcgaaagtgcgcatcttcgagctgacggctgtagcgttgagtgaggccggtatcgagctgaagcttaccgatcgcaatgtccgcttcgactcggagcaagagtgtcaaaacattcatggcggcgattgggggaagcgactgaagggcgtatccgctcgtcagaactgatcagtctcacaacgaggcaccgcaaaggcttcgcggtgatggctatgcaggtcaggggtgaggcccttgcacaacgcttcacaaaagaatttgaaccgctctcggacacgctcgcctaatgattagcctatgggtattcccacaggcgatgtgccaataccggcatgctccgagaggtggtcaacgtggctaaagacgataagaaaagcaaaggtgaagcttccaaagccagtaaagagttgaaagacaaaaaggcatcaccgacgaagaaagctgcggcggcctcgacgctttcgaaatcctctgacaaggacaagaaagacaagaaaaaagaccctgaaccgaagaaatccgccaagaaagctgacagcaagcccgaaaaaaccaagaaatcagacaaggcagaaaagcctgcgaaaaagaaaaagtagtttctgctgcctgccagggctttgcgccctggcaacttcagacaatggttagagcgcggatgtcattcaaaccatatatcgcggttgctgagccacttccaacccatggcgaacgctctgaagaacgcccgcccaggccgttagaaatcaactcggcatcagcaccgtatcgatgacatgaatcacgccgttggattgcatcacgtcagcgacggtgattgcagccttgccaccttttgcttccaccaaccacagtttgccgtcgtgcaacatgacggtcagcgattcgccctgaacggttttcagcatcactttgccactgtgcattttcgcgtcatccatcaactgcttggcggtgtgggtgccggcgacgacgtggcaggtcaggatcttcgtcaggtctgccttgtgttccgggttgaccagcgtatcgacagtcccggcgggcagcttggcgaaggcctaattgttggaggcgaagacggtaaaggggcctttgctgttgagcgtatcaaccagtcctgcagccttgaccgcggcaacgagcgtcgtgtgatccttggagttgacggcgttttcgacgatggttttcgtcggatacatggcggcgccaccgaccatgacggtgtcggcggcgaaaccgagtccagcgccaaggctcagcactgtgagcaggtaagggcaatgcgtttgatgaacgtgtgcatgatgcatctcctgaattcttcgacccttcgggtgagggtgatgaatttacggagcagggggggaatggatgcagtgtgggggggattttgatcgcggtttttgattggcgcagggcgtttgtggatggctgctatcggccacaagcggacattctcacagtatcttgatagacatccttgaggcctgagaggctctctgaaattggggacgactcactgcgactccaccttagggccgcgctgtactcgtcctcataactacctgcccagaagtctgcttgaggtaaggactaaatagtattgctgccctcaacgaatgtgccgccgacatgcaattgctcaaggattttgagagccaagaggccatagactacttcaggcttggtgtcatttcggacgtaccggatgtgggtaacgacatgtgaggtgccaaagcgtcgattcgcctccgatgttccttcgagtacgcttgcaacgatatcagcctcaactaatggttcgtgattacatgccccctgcggcgggagacactcacagatcggctcatgctgctcaccaactcctaggcgcagttgcaggagattatgccgaggcccagtaatacgtgaagcggcaaggtactctccgtggcggacgaaatgcatgtgatgtggctctactgtttggttaaagggtgcactctagcccatcgtagaggctcaatcatgcccgtcgagtggagcagcttgctggcattagtggcaaccactctgaaggaatgtccgtcgttctttcacagtactgaatcggtccttcttccgtggacgctttcaaaggaccgattctggccgaaagcaggcattcacaagcgcctttcggacgtaacgccaagtgtccttaaacacaacgcaaaaaacgttaaacaatcacgaccttcagcgatgcgaccgcgccgatggtgacgtgcaactcaaccgcagccgcagccagactgcccaagcgggcgacgctctcgaatactttgaaattgtgcagaggggggaatgccatttcatctccgtaacaacaacgcatcggaccgcagttttgtttacaggaacgcagtttgcagcttggtgattacttcttcgaccgacagccccggcgcctctggaggtgtcgggttttctccaaactccctccagataaacagtgtcagctcggcaccgtcagtcgccgcgagagcgttttcagcgtaggcaaagtttgccagttgccgatagcgctcatccttccagaacaagtcttcgacccagtgataaacaggaatgaaatggaagtgaatgggccagcccggttgatgaccaaagcggccaatgtagagatgcgcaggagttaatatccgctccatgatctgctgggtcctggcgagcaggccgcccatttccgccagggcttcagccgataagtcagccaatgaagaagttttgagtttggagcccagcatcagatagccggggagggcacttgccaggtggtggttgataagccagtggtcggtttcatgaacaatgaactgcggggcaatatccatctgccgtttgtcctgatgaagtggatgcggcagagtaacaaagcttgtttggcaaagctgcgaatgactgcgtgtggcgtcagccattgaacactgcacagccatgggtaagggagggaaccggatgaaccacgaagcgcagctcaaggctttgctggctcaagatcgagtacgaatgcaggttctgcggactgttcgtggcctcgaattgccggactgctgggtcgcggcaggttttgtgcgcagtctggtctgggatcacctgcatcagcgcaacgccgataccccctatcattcggccaccgatgcgatgacctgttggccggaaaccgccacggcggtgggcgtcaggttggggggggacgacgaaatagaagtggcggcgccgctgggactggacgatctgttctcgttggtggtgcggccaaccgagcgattccgcactgaaaaatacgcgctgttcctggaccgggttcaatccaagagatggcaggaaatctggccggagttgatcgtcgtcacggcgtgatgagggacatacgccaatttgcgtaagcggactcaaggttcgccaatcctgatttgatcattggcaatgagcgttgtgttgctagaggaagccgccttgacctgctcactgatcaggtcagccatcttccgcaccggttcagtcatgctgcggcgagagcgatggaccaggccgatatcccggtgaaaagtgtgcgccccgaggtcgagtgcccgcacgcctgccggccattgcggttcgggcgttgtttgcggcaccagcgcaacgccgacagcgttttccaccagtttgacaatcgcctccagctcatccagttcgcacacctcatgcaaggtgaaatgcatttgccgcagaaagcggtcgacctgtctgccgccgaaggatgatcggtcatagcgaatgaagggttggctggagagcagttcagaccagtcttctcccggcacgtcgcgcggcacgatcaagcggtaaggctccagcgtcagagtcgtccagcgcagatcgctctgcagcgagaaaggcgggcgaatgatgacggccatgtcgatctcgccagcgtcgacgaggttcaccatctccatcgacagccccgggaccacacgcgtgcggcactgcggacaatgttggtgaaacttcgccagcgcatccggcaaataggaacgctgcaccgacgcgatcgcgccgatgttgaccagcacactgggcggttgtcccatcgtcgtcgagcccagattttcgtaaagcctgagcaactcctgcgcttgcagaagaatctggtggcccattttgttgaggtgcgccgagcggcctttcctgtcgaatatctcgaagccgagttcagcctccagccgctggatttgtgcgctgacggcggcctgcgtgagaccgatcttgttgccggccgcagcgaatgtgccttcgcgcgccacagcgatgagtgtcttgagttctttgatcattcacaaatattaattgtgtttctaagaaatatatattgatttttctgtttggttttccgtcctaggatgtttcccatccccggcaacggctgaaccgagagcgccaatgacggtgggaattcgccaaccaacaaaaatatccggagttctgatgagcctttcacctttccacctggcaatccctgtttacgacctggcttcagcgcggaccttttacggtgaggtatttggtcttgaagaagggcgctccagcacacagtgggtcgacttcgatttttatggtcaccaactggtcattcacgaacatccgaaaaccgcctcgcaagagagcgttcacagcaacccggtcgatggtcacgatgtgccggtgccgcacttcggcatcatcctgggttgggcgcaatgggaagcgctggccgagcgtctgaagtcgtttgggaccgagtttgtgatcgagccgtacgttcgtttcaaaggtcaggtgggcgagcaagccaccatgtttctgttcgacccgtgcggcaacgccctcgagttcaaggctttcaaggatatgagccaactgttcgccaagtaacaacaggcatggcacaaccgcgttgtgccatttgatctctagtgagctggaagctcatgactctagcaactgcgcattacccgcagacctttcattccaacaagaaggctagacatgaaacgtattcccttggtgtggcaaatcgttgccgggctgttgcttggcgtgctcgtcggttggtacttcaatacgcatccgcagtatcaaacatgggtcagcgccgagatcctcaaaccgctcggtgacatctttatcaagatgatgaagatggtggttgtaccgattgtgttctgttgcatgatcctggggattgcaggcggtggcgacagcaagtcgtttggccggatgggggcgaagtcgctcggctacttctttgcgattaccgcgctggcgatcgtcataggcttgtgtttcgccaacctcttcgagcccggcaccgggaccgatatttcaggcgtctcgcacagttcggcggccattaacctggagccttcgaaaggcgccttggtgattttgcagaacatcgttccagacaacgtgatcgtggcgatgtcggaggcgaagttgctgtcggtgttgttcttcgccgtgctgttgggcctggcattgaacgcattgccgaaagacaaaagtgcgcctttcatcgccgtggttcagagcctctctgatgcgatgttcaaagtcgtctcaattgtcatggcctacgcgccaatcggggtgtttggcatgatcggcgcgacggtagcgacgtttggtttcgcctcattgttgccgctgctcaagttgattggcgtggtgtatctggcactgatggttttcgctttggtggtgctgggtggcatttgctacttgattggcgaaaacattttcaagttgatccgctacttccgcaacgagttgattctggcgttttccagtgcagcctcagcggcggtcatgccgcaattgatgaccaagctggagagctacggtgtaccgcgtcggatcgtcagtttcgtggtgccggtgggctatgcattcaatctcgatggcgcgtcgatttttctcggcgtggcgacaatctttgtcgcgcagctttatggcatcgacctgtcgttgtctcagcagattctgctggtggtgacgatggtgctgacctccaaaggggcggcaggggtgccgggttttgccatcatcattctgtcagccacattggcttcagccgggctgccgttggaaggcgtggcgctgattgccggtatcttcaggatcatcgacagcggcaccaccacgttgaatgtattgggtaatgccattgcaccgctggtgatcgccaagtgggagaaggtcgaactgcaaccgctacccgctcacccagcggcaagggtctagccgggacaacgcagctttgcggttgcaccgatcacacgtgcacgtctgctgacacagggacgttttttttgggtttgtttactagacgaccggtctattgattgtgaggatttatgacggattacgcttcagacaccgaccttttttcacccgtgaccatgggcgcactgcaactggccaaccggattgtcatggctccggtgacccgtagccgaatggccgaagacggcgtaccgaatgaaatgcacgcgacgtactacgcccaacgcgccagtgccggcctgatcattgccgaggcgacgaatatttccgcgcaaggccgaggctatgcgatgacgccgggaatctggtcggaagagcaggtcgccggctggaaaaaagtcaccgacgccgtacacgcagcgggcggcaaaatcgtcagccagttgtggcacgtggggcgtttttccagcgtcgagttacagcccggcggcgctgcgccggtggcgccttcggcgatcaaggcggaaggcagcacgtacaccgagaaaggttttgtcgaggtgtcgatgccgcgcgcactggagacctgggaaattccagggatcatcgagcagtacaggctggccgccgaaaatgccaagcgcgccggtttcgacggcgtggaagtccactccgccaacagctatctgctcgaccagttcctgcgcgactccaccaaccagcgcacggaccgatacggcggctccattgaaaaccgcgctcgactgactctggaagtcaccgaagccgtggtctcgatctggggcagcgagcgcgtcgggattcgtctttcgccggtcacgccggacgccggtaatacgccgcccgacagcaatgtcatggcgacttacggttacctgatccggcaactcaaccccctcaatctggcctatctgcatttcgtcgaaggcgccacggccacctcgcgcaccgtgcctgaagatgtggatctggatgcattgagtgcgcagttcacaggggcattcatcggcaataacaactacgacctggcgatggcactggagcgtcgggcgcagggccggattgatgcggtggcgtttggtcgtctgttcatttccaaccccgacctcgtgacgcgtctgcgtcgtgggctcgaactgaccatcgcgccacgcgagagttactacggcggtggcgccaagggttacaccgactggccaaccgccaacgcctgaaaaaccacgacctgcgcccggtacgacgcagggtcgccaacgcattatcgccaagaggtgtgagcatgaattatctgcaaaacaaggtcgccatcgtcacgggcgcatcgtctggtatcggcgcggcaaccacccgcgcgctggccgcagagggtgtccgcgtggtggctgcggcactggatacagagggcctggaagccttcgtcggccaattgcgcgaaaccggccatgaagtgctcgcgttcaccactgacgtcactcaagcggagcagacccaggcactggccagattcgcccgggaaacttacggcaccgtcgacattctggtgaacaacgccgggctgatgctgttttccaactgggtcgacctggccgtgcaggattgggaaaagatgatcgacgtgaacatcaaaggctatctgaacgccatcgcggcggtgctgcctgtgatgctcgagcagaagtccgggcagatcctcaacatggactcggtggcgggccatcaggtcggcccggccgcaggcgtttacagcgccaccaaattctttgtccaggccatgaccgagtccatgcgcaaggaactcggtgtgcagcatggcattcgcgtcaacacggtcagccccggcgtgatcaataccggctgggcggacaaggtcagtgatcccgaggggcgcaaagcggcccaggcgcttaaccggatcgccatcgcaccggacgatatcgcccgcgcggtgatctacgcactcaaccagccggaaaacgtcaccgtcaacgacttgatcatctcgccgacgcgccaggattggtgacgtttatagcggctgttttgccccatttgctttacccgaaagcgactttgatcgctcgtctacatcaagaggaaacaaccatgtcaaaaaacatcaaggcagtatcgaccgctgaatacaacgctgtcatcgccaccgccaatcagtatgtcgaaggtttgcgggtcggcagcgctgctggcgttgcacaggccttccataaagatgcagtgatgtacggtttcaccaacggcgaactgctgggtggcccgatcagcaacctgttcgattttgtcgagaagaacggtggcgcccctgaaatcaccacgcgcctggacgtactggcaatcaccccgaccaccgccgtggtgcgtgtcgatatggagaacgatgcgattggcgccgactacaacgactatctgacgctgatcaaaatggacagcgtctggaaggtgattgccaaggtgtatcaccagttcgacgcgtaagcatcaaccggtcccggcaggcctgttgccgggatcggcgaactgtctatttgaagggtttatacgatgacaatggttgagtattccgctgttctggagggcaatgcagagcaggtctgggacgtcttgaagaaatttggcgagatccataaatggcatccttcgattgtgaacagcgagatcgaaggcggcgtgcctgatggcctgacaggttgcgttcgcagactggtcctggccgatggcgctgtggtcagggagcgcttgttgtcggtcgatgatcgaggattaacgctgtcctatcgtttcgaggaagcacccttgccgctggataattacgtggcgacgatacggttggttgcgttgacggagtgcagccagacgctggtcacctggtcggcaagtttcgacctgcaacagccgactacggccgagcagtatcaggcgttgattcgcagcctgattgtcgagggacacaaggggcttcaggcattgctgtttcagtaatgtacgacgctggccagtggcgagcggcatttcattcgccactggtttgtcattacggcgttatttaacacgcgtccaatacccgcgtgtcgacacccaccacctccgggggcatttcgttgatcaacacaacggcgtcatccccacggttcagatagatcaggtagtcgccggtctcgaaggtaattttgaaaccgaccagccggctctgctgatccggccacttgtcgaaaacgccttgaacctgtgtgatgagcttgcctgccaccgtaaggctggataactcggccagcaaatcctctcgccgccacgagcattcaccatcctcctcaatgcgaaaagatgccggcaattgcaggtccgcttgatcggcgccgacactttcaccatcgctgagcaggtacatcgcaagggtttgatcttcgccaaaccgccatagcagtgaacctgcatctcgcgggcacggttcaccgttaaaatagtactggtcgtgcagtagcgcgtgaagtgtctggcctaccagtaagcgtgcctggcttaaatccacggccatcctttcgcgagaggcgataaaacggttcaacacttagcactacctcttgatgcggggtcagcaggctgcgaattttagccgggccgggcgtattctgtcgccgacagcacgctgataaagtgcacgcggcacggtgtttcggctggagtgttctttgggggcgtcatgaagttttcagaaatattgtggggctggtatggccaggatgagtacagccgggttttttccgtttgcgaagggttgcaggcgcttgattttttggccatgacggcggatttgcagcgatgtgggattccgtactgcccggcttgtgaaacctggtctgaagtgatgttgccactggaaagaacgctcaccgcttgcggcagcgcgttacccgtagagatcagaacgcgcctgcaacttctctgggagcagtgtaatgcgctgactgacgcggcttttcactgtgacgactggttcatgttcgatcatgaagagtggcagccacttcggaccacagctgcagcgttgatgcagttgatggattgggaggaaatcgaacccttccgcgaacaattactggaagactgccgcaacgctatccgtggcgtaaaaccgcgagtctgtgaataagcgccaatcgctggtgaggggcattcctcaggggaatgccaagaataaaattaatgaattttgcttgtctccgttcacggcgtaagttgctcaaataacaaggagcaacgccatgcaatcgacctctgcaaaaaaattcgacgccgcccgcgccaacgaatacgcccagcaaagtcgtatcgccctggccggttatgacgcctgtcacgatctggccgcgtgcatgttggccgccagtctcggccagtctcgatcggccagggtgctggtggtcggcgcgggtggtacggcgcaggagatcattgcgatgggcgcgctggagccgggttggacgttcaccgctgtcgatccttctgcgccgatgctggaggccgcgacgcagcagttacaggctaacgatctgttgcacagaacgcaggtgcatctggggcaggtcgaggatctgccggcgaatgagagctttgatgcagcgaccttgatcggcgtgctccatcacctgccgggcgatgcggccaagcagcaaatcctgcgcgcggttcaggctcgactcaagccaggcgcgccattgattgtggcgggcaatcattacgcctacgccagccaaccgttgttgcttcaggcctggggccagcgctggcggcagcagggtgcgagtgcgcaggaggtacaggccaagctggggaagattctgcagggcgctgatcctccgcattccgaagttgcggttcagcagttgctgcatgacgccgggtttggtgatgcaacgcgatttttcagcagtcttttctggggcgcctggctggtgtgtaaaacgctctgagcgcgggtcttacagggttctgcggctgattcagatcggtctcgtgttgccggtttgggatggcaagatcagaagatcgcagccttcggcagctcctacaggtaactctattccaatgtaggagctgccgaaggctgcgatcttttgatctttaaaaatgctgctcgacgacataacggctcggcacttcccccagcaattgcttgaataccgtggcaaacgcgcttgaactgctataccccaacgccatggcaacctgagtgaccgactgacctttgcccagcatcaccactgctgcgagcagacaagcctgttgccgccattcgataaaactgatcccggtgtgcagtcggaaatgtcgggtaaaggtgcgccggctcattcccgcacgtacggccatctcatcgatacccacttccagcgaaggcaggttcaggaactcgcgacacaccgacgccagacggggttctgccggcagcggcgcattcagcgacagtacgggcatcgcggcaatctcgtgcagcagcagactcatcaaatgaccgtcgcgcccttggctggaatagcgcgccggcacgtcaatggctttcaacagcaactgccgcagcaatgacgacacgtcgagtacctggcattggtccgacagccccagtcgctgcgccgcctgtttgcggatataggtgttgtgcagggtcaccggcccacgcatttgcatggagtgggggagttgcgcgggcacccagatgccgcgctggggtggaacgacccagttgccgtcatcggtgaacacggtgatgacgccgctggcggcgtaagcgaactgaccccgttgatgatcgtgcagcgggaacaacgtaccgtccgcgtaatcaacggcggtcacgaccgcatcgcgtggtgtgttctggtagggatgaccggtgaatgtgcgcatggcccgattctaatgaaagatggcctgtggctgaaagcgggccagctcgattgcttgcatatttctcccggcacgagcacttccgctcggcgtggggacgattgaacatgcaaaagaaacaccttctactggcgattctggttacagcggtgtgggggctgaatttccccgtgaccaagctgggcctggccaatatcgatccgttgttgctgaccgcgttgcgtttcgcgctggcggcgttgccctgggtgtttttcgtcgagcgcccacgggtagcgtttcgatggctagccgcttacggactgatctttggcgtcgcgatgtgggcgttgatcaatcagggcatcgcatggggagtgccgccgggcacggcatcactgctgatccagtgcagtgcgtttttcactttgggctggggcgtgattttttttggcgagcgtctcgggcgcccgcaattgctcggcgcgctgttggcggccgcagggttgctgggcatcgtcttgtgcagccctggcgccgcgtcgagggcagggctggcactggtgattggcagcgcgatggcctggagcgtcggcaacgtcatcatcaaagtgtcgaaggtgcgcgagatcttcgcgttcgtggtgtgggccagcctgtttccgccgatcccgctgatgttgctgacgtgggctctgcatggctcggcaccctttatcgcactgcctgcgcagctcaatgcgatgaccgtgttttcactcgcgttccaggtgtatgcagcgacgcacttcagttattggggctggaacctgctattgcgcgaatacccgatctcgcgcgtggctccgctgtcgctgttgatcccggtgtttggcatcttcagttcgatggcgattctcggccaacatccgagtcctgcggagtggggattgatcctgttggtgctggtggcgatcgtattgggttcagggtacttgcagggcgtgtgttcgcgccgtcgtgcgcgaatggcctgagcatcgctgacggggcgatgtggcatttagggaaggacttgagtatccacctggccgctagtggaccgatcaaacgtcgcgccaccttggaatctgcaaacgcgccctcataataatggctataccaatgccctcaagaggaagcacaaatcatgacccgtcaaaccgaaactgccattctcgccggcggctgcttctggggcatgcaggatttgttgcgccgttatcccggcgtgctgcaaacccgcgtcggctataccggcggcgatgtgccgaatgccacgtaccgcaaccatggcaaccacgccgaagccatcgaaatcgttttcgatccggcggtgatcagctatcggcagatcctcgagttcttcttccagatccacgatccaagcacacccaaccgccagggcaatgacctggggccaagctatcgttcggcaatttattacctcagtgaagcgcaacgcgatatcgccgaagacaccgccgccgatgtcgacgcgtcgcacctgtggccaggccgagtggtgaccgaaatcgaaccggccggaccgttctgggaagcggaaccggagcatcaggattacctggaacgtatcccgaatggctacacctgccacttcatccggccgaactggaaactgccgaaacgctgagagacttcagcagggcgcgtttactgcgccgcaaaacaaaaagcccctgagatcaggggctttttcgttatagctcataaggtttttcttttatgtagtgaatgacagccacgtccatggcgcagcctccgatttgagtggctgacgctatcgcgctgtgccgctggttatccaatttcctgcgttcttgtcataacccggcaactcaatcgcatcagccttcggcgaaagaattttcccgaacaccttctccaacccggcgccgtctaatcgcaagcttgcggctgattcagcgacacaacataagcgctgaacatgtctgccagcgcgtcggcaaacacgctgatttcctgctcgctgcgtgggctggaggaaaagtcttttccggtagaactcagcgtggtcaggatcaaatcgcaggccgctgtgcgaatcgcgtcagtgacttgcggcaacagttcgagcatgaagctggcgaagatctgccgtcctgccgcgcgcacctcatgggcttcgggcgcatcgcgatagagcggcgcggcatcgttgagcgcgccgcgcatctgcgcttcctcgcactccgaacgaatgaatacctggaccagcgtgcgcaggcgatccagtggtggttgttccggctgctgcaaaatttgctggagcatttgcgtggtgtgcagccactcatcactctgcaagcggaacagaatcgccgccttgttggggaagtactggtacagcgaaccgatgctcacgccagccttttcggcgactcgggcggtggtgaagcgggtggcgccatgctcggtcaaaacctgaatagccgcctgcaaaatcgctgcgacaagatctgtcgaacgcgcttgctgtggctgtttacgcgaggaaatacgggcggtctggcggtcggtcatggctggctcggacgtcctggggaatgcgaatagcggatgcgacgaatcactcgcatcatttaaacgcgatgaatcactcgcattttagtccccaactgacggaaaacaagcatgaccaccctgacctctgaaccactggcgagcttgatcgaacgcctttacagccaagccagcgccgccaccagcacggcgctgaacgatgtatccggcgaagaacgcgatcgcctgatgcacagcaaaaccgactacctgaaactctacggattactcaaagacctgtggctgccggtctcccgcgacaccggcaaactcctttacatgctggcgcgcaatacccaggccaaggcgattgtcgagttcggcacatcgttcggtctgtccaccctgcacttggccgccgcactgcgcgacaacggtggcggtgtgctgatcggcagcgaattcgagccggcgaaaatccaattggcgcgccaacactttgttgccggcggggtcagcgatctggtggaaattcgcgagggcgatgcgttgatcaccctggccagtgacctcccggaatctgtcgatttgctgttgctcgatggcgccaaggcattgtatggcgatgtcttgagcctgctcgaaaagcacctgaaaccgggtgcaatggtcgtcgccgacaacaccgactattgcccggattacttggcatacgtgcgcgcgccggagaacggttacctgtccgtaccgtttgccgacgacatcgagctgtcaatgcgcctgggctaaaaccgaccgcctcaggggccaccgaaaggtggtccccgagggccgtaatcaaggcgtgcttcggatcgaagttaacgccggtgacggttgtccggccgctccagccccagatgatcgcgcagggtggtgccgctgtattcatggcggaacagcccgcgctgttgcagcaacggcaccacgtcatcgacgaattcatccaggccttcaggcaggaacgacggcatgatgttgaaaccgtcggcggcctgttcgacgaaccattgttcgagggtgtcggcgatggttttcggcgtaccgatcaccgtgtgatggccgcgcgcgcccgcgactttcaggtacagctggcgaatgcttagattctcgcgccgcgccagatcgatgaacaaggcctgacgactctgcatcgaattgctcggtggcagctccggcaacgggccgtccagatcatattcggagaggtcaaaaccgccggccatgcctgccagcatcgccagcccgacacgcggctcgaccagatcctgcagttgttggtatttatcttccgcctcgctttgcgtgcggccgatgactggcgaaatccccgggatgactttcaattgctcagggcggcgtccgtagccggccagacgacctttgacgtcggcataaaaggcctgggcgttggccagcgtctgctgtgcggtgaacaccacttccgcggtgcgtgcggcgagtgccttgcccggctccgacgagccggcctggatcagcaccggataaccctggggcgtgcgaggaatgttcagggggccgcgcacccggtagttatcgccatggtgattgagtacatgcagtttgtccggctgaaaaaacaccccgctgcttttgtcgcggacgaaggcgtcgtcttcaaagctgtcccacagaccggtgacgacatcgatgaattcttccgcgcgctgataacggtcaccgtgctcgaaatgtttttcgcggccaaagttcagcgcttccagatcggtcgctgaggtcaccagattccagccgctgcgcccgccgctcaagtgatcgagggaagcgaatttgcgcgccagtagatagggttcgttgtagctggtcgacaccgttgatacgaggccaatacgttcggtcactgcggctagcccggaaagcagcaccaacgggtcgaagacgtcgccggccgtggtgaactggccgagttccggcgagcccatcagggccagattgtcggcgaagaatatcgcgtcgaacttgccgcgctcggcggtggtggcgagtttcctgaaatgctggaaatccaggccgccgcccgaccatgcacgtggatggcgccacgcggcgaggtgatggccgctgctcatgagaaacgcgccaaggctcatttgtgctgttttcatagtgtcctcagaagtcataacgcaaggtcacgccggcggtgcgcggctggcctggcgaggcggtgtagaggccattggaaccactgccaacagccaggtaatactcacgatcaaaagcgtttttgacccacagcgaggcgtcgagcaaaccgtcgccatagtccacccgtgcgccgaatgagaagttggcgaggccgtagccatcgatcttcgccaggtcggaattgtccagcgtgccttcgctgtcggagcggtaggcatagctgccggtggcgtagggttcgataccgtcgatgcgcggccatttgtattcgccgttgacgttgccgatccagcgcgaggcgccggctacgcgctggccgctgaggtcgcagttggtttgccccggattttccgaagggcagggcgcgtctttgaatgacaggtaagtcacgtcgttgaacgagccgttgacgtttaacgtcaggccgcgaaccggaacggtggtcgcctcgaactcgaagccacgcgagcgcacggtgccggcgttggtcagcaactgataaccggtcaacgaaccgggcggctggtaataagtggtggcttgatagccgttcaccccggtccagaatacgttcgcgttgagttgcaaacggtgatcgaacaattggcttttaatgcccagctcagcatcgttcgcgcgttccgggccaaccaacaatgacttggcgccagcgctgggcgccgaaccgacggcgaggttgacgcccccggatttctcgccgtgggacagcgaggtgtagcccagcacgtcatcgctgaagtgatagctcaaactggtcaggaacgatggcgccgcgttgtgcatgtgcaggtcgccagtgtcataggcgccgacctgacttgcgcgcaccgcgttgccattgacgactcccggaatcaccaccggcgcgccaccgccctcgggggcgaagcgtttcacgttggcgtctttttcttcataggtgccacggatgccggcgctgaaatccaggcgctcactcaagtgccaggtgccttgggcaaacagggcgtagctctcggtgtcgatcttgccgttgaccttgctgttgacgttgttcagcgcattgagattggtgccgatcaggttgagatcggccagcggtccgagattggtaaagatccgatttccgaggtcttgcttgaaggcataggcgccgacgacgtagtcgaaaaactcgcccttgggcgaggccagacgcacttcctgggagaactgccggtcgtgcacttcgtagccgaagtcgttgatcaccgggacgtccagttggtcggcgtcgttggccgggttgaaatgccagctacgataggcgctgatcgacgtcagggtatagccgccggcgaggttccaattggcttcgacggaactggcgttctggtggacgctgacattctgccggccgtcgatgttgctttcgcccacctgcggattagccccgaccaatgccgcccggcgccagaacagtgggccggcgccatagatcacgctgctgccgctgctggagttttccgtgttgtattcgttgatccagcgcaggctgaaatcatcgttgggtttgaacagcaactgcccgcgcaggccttcgcgttcaccgccgagcaacgtgcgatcgtcatgccggttgttcaagtagccgtcatcgcgggtgcggtagaacgacaggcgcgcggcgagggtgtcggtcaacggcccggacacagtgcctttaccctgaaaatagccgtcctgcccacccgacacttcgaggctgcgttcgggcgtaaaggtcgggccgcgcgtggtgatgttgagcacaccggccgtggtgttcttgccgaacaacgtaccttgcggcccgcgtaacagctccagttgctcaacgtcgagcatgtcgaacgcggccatgccggggcggcccagatagacgttatccaaataaatcccggcgctgccttccagtccatcgctggctgggttattgccgatcccgcgcaccgcgaagctggaaacccgtgcgtgaacgtaagcgacgttgacgctgggcaacgcctgttgcaggtcctgaatcttgtagatgcgctggctttccagattggcgccgctgagggtggtgatcggcgtcggtacgtcctgcgactgttcttcgcggcgccgcgctgtcacggtgacctgttcaagccgtggggcggcgtcgtcggcgttggccgttggattttcgcgttgatcggcggcaacgctgacggtcgagcaaaggacagcgggcagcgccagccataaggaaaaacccaggggcttgaggcgatgggccgtggtggccgggtaacgtaacagcatggacgcaaagctccttgtttggccgcgcgacgctatcggtcgggctcggtaggagggccatgctagagcgtgtgaagaggggaaaaggggcctgcgcggacaacctgtggtccgccgcagacaattgattcaaacggctatcgagatcgcccgcccggaggctaaagcaggcggtcgtggcacatagcgttcgggtaacgacggcgcatcatcgcggcgccatttgccggggctttcgccggtccagcgacggaacgcgcgattgaaactgctcggttcattgaagcccagtcgatagcagatttcgttgatcgagcagtcggtctggcgcaggtaactgaacgccagttgtcgacggcaatcgtcgagcaatgccttgaaactgctgtcgtgcttgagcaagtgtcgatgcaggttgcgcacgctcatgccgagttcatcggcgactcgactttgctgcacttcgcccaccggcaagtagcgaataatcgcaccgcgcacccgctccggcaggttcaggcggcgctggcgttcaaggtaagcgttgagcacgttgtccagtccctgggccacggcgtgattggccgtggtcagcggtgcatccagccagcgattgctgtattcgatggcgttttcgccggcattgaagcggatcggacaaccgagcaatcgcgtccagcgctgcggatcctgtggcgccgggcgagccaggcgcacgccgtgcacgatgggcagattgacccaggtctggcgggtgaagcgtaccgcgcaggcaatcgacgcttcggtggcgatctgctccacctcggcgccgacggccaccccgtaaaccatgcgcgtggtgtgcgggccgcgcaccagactcatcgccgccgacgtggtgatcaccggcgcaaaacgcacgccgcgctgcaatgcctcgatcaccgtcgagctgctttgcgcggcgaaaaacagcccatggaagtcggtcggataactgtactgcgccacttgcaagccaaagcattcgtcatcactgacgcgccgcgccgcccgccagaatgcactcatgacggggagggcgatgcgctggtcgggatcatgcagatgacaacgactgataccggcctcgcgcagcagcggggcagcgtcgatgccctgtgcttccagcgtgcgggcgatgacttgggcccaggtggcaatggtatcggtgcttggcatgctgtttctccggttggctcggttatctgtccacgggatgactcaggcgaggccttcggcagccagtgtccgcaccaccgattcgcgtgcacggaagcgcccgagcgcggcttgcaacgcagggaagtcgcctaacacaccgacgcgggcgctccagccgaggaacacgccgaggtaggcgtccgccacggtaaaacgattgccgaccagatactccgcctgcgccagatgcgcctcaatcggcttcagtgcgttcgccagttgttgcaacgcgcgctcgcggatgccggggaatgccgcctcatcggcgctgtaacgctcaggccgattgatcggccgaaacgcggcgacgtgcacctcggtcgccacgtaaccgagccagccttgaatctgtgcacgctcgactgaacctgccggcgcaaacaattccgtgccgggtttcaaatcggcgaggtacggcaggatcgcggtattttcagtcaacagggttttgttatcgagcaatagcgcgggtacgcggccggtcgggttgatctgccggtatggcgagtcctggtcgccgaacgtcacccgctcgacatcgatcggcagttgcaattcgtgaatcacgacatgggcggcgaacgagcaggcaccaggaaaaatgaacagggtggtcatgggtagtccttgtttttaacggctggcttgtggggtttgcgaagcgctgtcggtggcttgcagtgcggcattgatgaagctcggttcagcccagttcttcacctcgaaacctttgcggatcagtttcgcgttgagcgcgagatccacactgcgctgcaagttgtcgaggaacggcgcgtcgagctgcggcgcgaagattttcaccagcgactgatctttggcatcggtggtgaggatatctgcggggaaactggccagtttcgacaccagattaatgtagtcctgtttgtgctcgtcgttgcgcaaccaggtgatcgccggttgctgtgccttgatcaatcgcgcgaccagttccgggtgcgcgtcgacaaacgcgccgcgccccaacagcacggcttgcatgctgccggcgccatcgaggtcgacagtggtcagcggcagctcggcgagaccgcgtgccttgagcgcaatcaccccggctccggaccaggtcgcgtcgatttgtttggccgccagcgccgcgttggcggcgttgtagtcgaggttgaccaccttgtagtcgctctctttcaaaccttgatgggccagcgccgaagcaaacgacaactgggtggcggtgccgcgaaagatcgccacacgtttacccttcaacgcttcgagcgtggtaatgcccgaacccggctgcaccgccagatagagtttgacgtcacgggcggttgcactgagcaagcgcgtgtcgagaccaccggccttgccgatgattgccggcaaatcgccgaggtaagcgaagtcttcctgattgttggccaacgcttcattgatcgccggccccgcacctttgaagaagtcccagcgaatcttgatgccgtccttctcaaactctttctccagcgtttgccggtcgcgcaacacatcgacgatcccggcgccactaggcgtggggccggcactgatgtccggcacggcgatgcggatttctttgaccggttcggccagtgccaggctggaaaccaggagtgcggcgagggtgagagccgctcttgggaaggataacgaaggggttcgaatcacgcgtctgctcctgcaaatgccggcgtggtgccggatcgaagacgcaggtatagcggcgtgttgatgcggaaataaaatacttaaaaatatgctgtttattcgtttgtggcatatggccgatggatcaacggctgcgcggacgatgcctggaaggcataaaaaatatgcgtcgaagcgtgcgagctgacctagtgatcgcgcaggtctgaaccagattggctgggccactgcgttggcttcaccttccgccaaggacatgccgaccgccaacgatgacaccgactacatgagtgcggtgctggatctgaccgaaccctatgtattgagtgtgccggatacccatgaccgctcatgggcgcgcccattattatcggcaacaactatgacctttgggtcagcaacagcatgaaagatgctttttgcgaggtactaaccgctgtcgcgaccttggaaggtcataatgttgaggctatttatgaggaggcgccgggtgtggccggcacctagggtatttcaggcgtgggtatcgttctcgacgagttctatctctatcttggcgggttttcaggcgttcgacgccacctcgatgtatgccgagtacggctagacgaagtcagcgagtcttgcggactgtcgccagtcgctgcaaagcgcatggcacacctgttggcatgcactgagaatggcgtcctttatcgggaaccgggtcatgtcgagctagacgaacgattcgatgagtcacgcaatgaagccgcgaaactcgccgagttcagaatgcgacatacatgatggggtgcagtcatcaaactacgttattcaaaagggtcaggtctgccaccgacgcatctgacattgatcaactgcgcagactccgctactggtagcctggtgtttgcctgcactgaagtcggggagtgcagagttcagtacacatcacgtgccgaattgttgtgcatgctcaatagtcttttgcgtcagcgcgtgcccattgctgttggtggcatggtcccgggacctgccgacgaagtcgacatgttaatagcgaacgcagtacttgaaggcccctatatagcactgtcgtggtccggtccgcagcaatggaccctgcgcgaaatcggctccaccgctgctgagtggcagccagtccctgatgctcaaagtatggaaaatgtgtcattcgacccgaggtccctgaaacgctcgggctgaattggccaggaaatcagtacaagttcgggcggttcattgcttctggcagtaaatgcatgcggtcgcaacaagcagcggttggcttcgctcagattgagattgatcaaactggtctttcacccagccgctctaccaacctgacgagataaccgtcgggatcctggacgatgaattcgcgttggcctatttctacatcattggcccgataccaagtgtctttgcattctcgatagagtggatgtctggcctgatcaagctgtttgatgaggggggcgacagccacaacgtcaatctgcaggttgatgcctcttccaaacggtgcagtcaacggagccgtcagccattgccccacttgtgattcaacctgctcaagcatgacttgagcaccattcaaatcaaggtaggcaaacccatcttcccggcgttcataaactaccttgaaaccgatgcaggaaacccaaaaggccaggctgctctccaggtgggtgaccattaactccggaaccagtttgttacgctcgaacattaggtgacttccatttcacaaggtcgatttttgcaggcaggctggatcagctctcagccgactcccccgaatccgcaaccaccagcccctcagcctccatcttcgcccgctcagccttactaatatacttcggcttcttcggcgccaacttcgcgctagccttcttggccttttccttgaacaactgtttcagtttcttctgacgattcatgtgtgttactcagtaagcaaaggtaaaaaaccaactatcgaagggcgtaaacgcaggcttccagcgcggtgccatcagccaacgtcacctgcgtcaaaacacgctgatactcagccccttcaaactcatcaagcgctgcccaatgagcgtgaaaattcccggaagaaaacacgaagccctcaatcacatcgccatcgtcggccaggaccaaccccggaaagcccatttgcgcgccccagcccgcttgcgccaagcggcccttgagtgaggccggttgccaggtgccgccgatgttcaacatgacgtgctcattcggtcgccccgggccaagggttccataaacgaatagatgctccacgagtgttccttgcgatcaaaaggggcgaatcctgacgcatggatcgggttcaggcaacgtcaattgctcacatcgcgataaagtcgcgtacggccttgatggttggggtcggtgcttcttccatcagccagtgtccagcggccgggatcaccacttcggtgacgttgtcggcggcgttgcgcatgacgatggcttcgttgttgccgaaggatttttcgccgccgacggccagtaccggcatggtcagtttctgttgcagaaccggcgcgttatcgatggcgtcctgacggatgctgcggaactgggcgaatgcggcgtgcatggcgccggggcgggcgtagagtttggcgtaatgctggcgggtgccttcgtcgaccttggcgggcgtgccggcaaactcgttccagaagcggtcgaggtagatgcgctcgcgcccggccaccagacgctccatgtcggcgccgccgaagtcgaagtgccaaagcatcggcgaacgcacgatgtcgttccacggcgtgatgccgggtacgggggcatccatcaccaccagccgatcagtgagttgcggataccgcgcggcataggcgaacgcgaccatggtgccgatgtcatggccgatcaccaccgaatgttcgattttcagcgcgctcaatactccacgaatgtctgccgcctgcgtcttcttgtcgtagccgccgtccgggatcgacgacaggcccatgccgcgcaagtccggcaccaccacggtgtggtcccgcgcaagatgcgccgccagcggcgcccacatgtcgccggtatcgccaaagccatgcaacagcaccacggccgggcctttgccgccaacgcgcacgtgcattgttgcgccttcgactttgatgtcctgggtcttgaaggcagcggggaacggcgtgacgtcagcgtgagccggcaggctgagggcgagcaaggtcagcgttgtgaaaaacaggcgggtcatgggacgagtccaggcgtgggggggatggaatgagcgtagtcgtatccgccatttgcgcctgtgaaggcgctgtgcatgaatcggcgtgcacgtggtcgatgcgctggcgccgtactttcccggcgtcgatgtgcagccgctgtacccgggccgatggcactacgccgaatacccggatcagccacagactgccggtagctatctgatcgaccgtctggtgaaggagcgcggcctcgatccggcgcgttacatccgtgctggcaacgccgctcctgccccgatcaactaaactgtctcacagcgaccaaaagacatcggtttacttaacgcagagggaacgccgcatgattggatcacgggcattgattgcagcggttgcatcgcttgcgctgattgtcagcgcggcaacgtcagccgatcccggtaatggcaatggcaatggcaatggcaatggcaatggcaatggcaaaggccagggcaacggcaagggcaatccccagaacatgcagggccacggtaaccagaaaggcaattccagcaagggcaacaacggtggtggcgactggagtcatggccccagcattgatcgcggcaatgtgctcgggattgtcggcggctaccgcgactactggagccccgggcctgcgctgcctcccggtattcaaaagaacctcgcccggggcaaaccgctgccgccggggatcgcgaaaaaactggatggacgtctgattgggcaactgccgcattacgatggctacgaatggcaacaggcgggcacggatctgatcctggtcgcgctggccaccgggctgatttatgaagtgctcaatggcgcgtttgattaagttgccgcttggctgaacgggcggtgcatccttgcaccacccaccccgatcaaacgattttcaaagcgctcagcacgatcagcgattgctcggcaaaggcctgggcctgttcggtcagcgcggcgatattggcttcggcagtggtcagcgttttgccgtccttgagcagcacttcgttttgctgggagatgacgctccacaccagttgcgcccattccgccgggtgctgtttgccttggcggatcgctatcaggaacagttgctggaagcggctgaccgcgacgccaccgccggtgaccgggctgctcagcacctgaatgtcggcgttgaacagggcgcgtttacacagttgcaggttgaacgcggcgcagcgttcgtacaccagcgcttcggtggcttcgctctggcagggggctacggcgcccatgccgaccaggatggcgagggcttgctcgagatcgtcataggccatcggcgccacgtcggcgagcaactgctgcatggttttggcttcatacgtctggcccgccagcgcatcgaggaccgggcggtaaatctccggttgcaacgaggcttcgccagcagggccagtgacgctggacgccacgttttctgccggctgcatcaggataaatcgggtcttgagcatgcgcgaccgacgctcggcagcgctaagtcggttggcaccgcgcacgtacagatcgcgacggaaagcctgattgacgaagtagtcacgcgcctgttcacgcatgatcggatgctcgataccgtcgagaaaggccagcccctcggcgctcagattgagcgcatcgaccgagtccatcggcaccgccgtcgtgacgtagtcgagcttggccggggccaacgcatcggccatgtcggcgaaaaacatgcagttccagtcgcgattgaaatattcgtgggcgacgtattggcgatcctgacctttgatggtctgcagcctggcgcccaggtgcggcgcggcgatcgcgtacttgggattggccgccagcagcgcctcggaaaactgcaacgcggcatcgatgcgctgatccgggcgggccgagtggctggcaaagcggtcatgcaggctgaacaattggcgcaacggcgctgaaggcgaccagcccggcaaagcgttgtagctgacgtacagatgaccacccggtttgaggtggcggcgggcgaactcgacgatcagtttgtggttgtcacggctgacccagctccagatgccatgcaggctgatgctgtcgaactgcggcaagtcctggcgcgccagcagttgctcgaagctgtcgtcatacagctttgcgccattgttgctgagttccgccagttcaatggcatgggccgcctgacccggatggaagtccgtaccgacgaaaccggcaggattggctgtggcgtggatgttgatcgacacgccctgaccgaagccgagttcgcagtggtagccgtcgggattttccagactggcaaagccgcgcaacaacaggcagtaacgctggaaaaccggattgatttcccggctatagctgtaggtgtagccttcgtcggtgaaataaccttcgttccaggcgttgctcataggtgcagcctcttgcatcaaaaatgagggatgggacttgcgtcgttcaatctggcgctgtccatcagggggttgtcggcaggatcgaaccattcgataggggccatgcggatatttcgcaggctcacgattgttcattgtcgcagctgtccgccgctcacaagcgcatgcccatttccagcgcacgcgtctcgaacccgaattccgcatacatacgcaccgcgcgttcgttgaacggccagaccgtcaggcgcaagtcctgggcatcctgctcgatggcccagtgtttgacccggtgcatcaacgcgcggccaatgcctttaccccagaacggctcggccacgcacaccgagccaatgcgcacgacattttgcggttgcaccaatggcccggtactggccgacacgctggccgtaataaacgcaacgacatgattgcccacgctcgcgaggaataccacctggcccggtttttcgaaaacgctggaccagtgcggcaagtcgcgtgcgaagtccccagtcgcggcggcgtagatgtcgggccgggctgcatggtgtaccgaattgagcaattggcccagctcgcacatcgccagtgcatcttcgacggtggcagttcgataggttatgtctttatccatgacgggtgacgctccttggtcatgttgggggctggtctgcgcgggtgtgcggcttgggccgtgtccagcggcaatcctgcatggcttggcaggcaacactttaccaaggttgcaagtcagcaggtgcagacacgctgccggacctgaacctgggtcgctttttcaggcaaatctgtacattgaatccttcggcgataaaccaataatcaagcgctcgaattcttggatattgggcactgtatggaaacgctacgcattgatcacgctttaccggcaatcgactcctgggggtgcgcatgagccttcatcttcgcaacagacgcctgactgtgccgcaactggtggccatgaaaggccaggagaaaatcgtttccctcacggcgtattccagccccatcgccaagttgatcgacccgatcgtcgactttattctggtcggtgattccacggccatggtcggttacggccgagcctcgacactgagcatgcagcttgaggaaatcatcggccacacccgcgcggtggtcgacagcacgcgcctggcctgcgtgattgccgacatgccgtttggcagttatcaggaatcccatgaacaggcatttcgcaattgcgcgcaggtgctggcgcgcaccggttgcgatgcggtcaagctggaagccaacaaggctttggcgtcgacggtcgagtttctggtggcgcgcggtattccggtgatggcgcacgtcgggttgatgccgcagttcgtcaacgtcatgggcggcttcaaggcacagggcctgactgctgaaacgggtgcgttgattgccgaagacgcgcgggccaatctcgacgccggcgccttcagcctggtgctggagggcgtcgctgaaggcgtggcccggcagattaccctggactcgaaaatgcccaccatcggtattggcgcttcgcctgcctgcgacgggcaggtgctggtcaccgaagatgtgctgggccttggcggtgagcatttgccgcgcttcgtcaaacgctacgccgacgtcggcgcggtgattcgtgatgcgtgtgcgcgttttgccgacgatgtgcgcgatggccgcttcccggaggcgcgccattgttatgggctttgagcgcggctagggttcggcgccgatagcctgcgccagtgtcttcagcgcctgagcaatgtccttgtcccagtcgacggtgtagctcaggcgcagatgctgttgccatgccccttgctggctgaagatttccccgggggcgatgacgatgcgctcagccagcaaacgctcgaacacccgttgcatgtctaccggatgcagcgctttgagccagaagctggcaccgccgtgcggggcgatcgcttgccagcggccattggcgtgttgctccagcaacgtctgcatctggtgcatgcgctggagcaatatcgttcgcagcgttttcaggtgcgggtcaatgcgcttggacaggtagagcctggcgatggctttctgtcggatcgtcgagagacgaaagccgcgcccgagaaatgatcgttgcagttgcggcccttgttggcggcacaggacatagccgtaaggggcttcggcaccgatgatcttatcgaaggtcgagaacaccaacagcctgtccggatcggcaaagtcgcgatagcgcgcggctgtgggagagaaacagaactcgccccaagtgtcattttcgaacagccagatatcgcgctcggccagccagcgacagatctgctgtttatcctgcgccggcatcaggctgccgtgggggatattcaccgtcgaggaaagcacggccaggcgcaccggttcgcgcgtgagcacttcgttgagcgcgggcaagtcgaagcgcccgtcgtcgccgagcgggatttcgatcacacgaatcctcgctgcctgcaactgacgcaaaatcgcccacgagcagggcgattccaccagtgcgacgctgccattgaggtccaatgcagtcagcgacaattcgaacacgctgcgcaagtccgcgccgatatacacctgctcggcctgccaatgattttcagcggaacgggtgtagcgttcggccacggcagcgcgtaattcggcctcgccaaatggctgataaagcggcgcgcgagactgcgggtattggcgagtcagttcgcgctcgatcatcaacaacggctgctgcagcgacagcagcatcgccggggcatcgctgctcagcgcaagcatgcccggctgacgggcgctggcaaagacgttatccagcaaattgcctgagcggggcgtcacaggcatcgccgacactgctcgggtgaaataaccgaatctggctttggcgtggattcggccctcgtcttcgagcagggcataggcgtatttggttgtcgacactgaaacgccgagacgctcggccagttgccgcagggacgggagtttctgctcgttcgcgccagtggctgtctcgatcaggccgacgagatagtgatagaccgcctgataggcgaaagaagcgtccttgcgtgtcgtcacgcggtgatccttaaggggcgagtcggtcagaattctactggcattgggcaaataccagaaacgtcacttccggcaacgaccttcgaagtcggctataccctaaccgggtatggcgcagtgccatatccgtgcaagttacaagcatggagcgtgaatatgcgaaatcaactgctggtagccgtttcgttgctggcgttaggggggtgtcagtcaataaagattctgatgaccgataccgtggagcctgccagtggcgaaggcgagaaaacccgggttattccgattgtagtagaaacgttcaaaggaaacggttcgcagtgggaacagctattcggaaccgctgatcaatacgcatgggcaaataagtgccatgtctcattgcctgatcgcaacttagagacggcgccggttcccgcagcagtgttaacagcggtgggtggtgtcgtgtgggggctggccgttgatgcggtcaactccaaaatagatgaaatacaagagcggtccgtcaagtcctgggcagcgacatggacgggaaccagaggtggcttgaaagtcccgcaatgctttgcggtggtgcgcgtcagtgccgaaaaggtgccgaaagcgcagatggcgatcctgttcgaaatcaagggcgtcaataccggtaacgcaaatgcgccagcggttcagtgggcgccgttattggttgcgtcgcgaaccagtctggcgctgaccaagcgcgaaggagaggccggcaccatcggactgtcgctgtcagtagcggcgaaatctttcaaggaaggtgagttcacggtcaaggcgagtgacccgatcagtgtcagcggcattgttgtgtctacgccaggagagaatgcgccgcttcacgtcaagtcagtgacggatgaccagtattcggaccctttgcagttttacgcgaaagacgatgcggcgagtgtctatctgaagtttgccattgtcgaaagcggttcgatggccggcttgaacaccaaagccaaggccgagttcaaggcgtggaccgacgcactgggaccggttgcagcggatgcctggaagaaaaaactgactaaagcggatgatgaatgattttcaggttgtagcgatgtttttcaagaggctggcggtcaccgagcaggggatcgtcagttattttttggcgggtgcgatttcattgtgctattaccataggacctcatccgcagtgccctttggtaaagacgcctacgcaagtatcagcgccgcagtagggaaggatccgagaaacactggaccagggcctcgccgtagtcttgcgtctccctctgtcttgattgctttcctgtgcgctggaggctagacgtgagatgcctgtcccggatgatgttgcagatcagctgaattttgaggctgaagatcttgagcgaatcttcaatgaccctgtcgcttatgcccaggctgtcgaggtgttggcgcagatgcggctggggcgagacgataccccaagcgccgacggtctgaatgccggtaccgatggcgtcgatgtagatcgggccagcaactggatcgaagtgctcaagctcaaggattgtctttcctcgttcctgttggggctacgcgggcgaggtgtttggcctgcaccagccgttgatcctcccgtagaccccgacgattctgcaacgtcattcgatactaaaaagttaggtgattttctagtccggctggaatcctttcgatgcacgatccgcgttcaagggaatgtgaaaggctccggcattctggtcggaccaagttcggttctgaccgcttggcatgtcatcgccaaggcggggcaaaagcccgagcaggagttgttatcgaaaatcgatgtggtgcttgcagacgggcgcaagatcgacgttgcattgttgtcggcctcatcgccttgtggtgaggtggagtggcctccagtgggtggccgcgcacccaaaaatgacagcgaagtcgaacatgcgcacgatattgcgctgttgcgtctgaaaaagccggccggcattcatctgacttacgcgaaccttgccgcaccgccctatgcgttcaaggggactcccgatgtaatgttggtttcctacccagaaggccagtgggatggtattgagttcgccagactgcaacggctgcgtaatttgacggcgcgctggggctatagcacgcgcacaaacaagacaggctcttcgggcggtggttgcttcgacaaccaattcgctttgacaggtatacatcaaggacgagcgcaaggccttggccggctgatcccattgattcgtttccatgagcacgtcaaagaggccatcgccaacgacgaactgcccccaatgctctggtcgcttgacggcaccccgcagagcaatttgattgtcgggcgcgacgactttttcattggctaccagaccgccatgcgcgggtcgccacgcgccagagggttatggattcgccgggtcgatctagtcaatgatctgtccggtttgcctttcaccttcctgatgctcgaaagcctcgtggcacgcagcccgagcactcgtctgatccgcatcagtttcgatgcgattgtccatgacctgccgaatgaaatcgcccgccgcgcaaccgacgccgggctgagcgtccagccgccgacgccccaggctggcgcaggcatcgaccagaccgagcctgaggcgatgatcgctgatcgtgcccggcgcgtggcgcaatcactcaatgaacgtgcgcatgagcagggcattcgcctttgggtcttcttcgatcacccggcggtcatgttcggcgatgagccccggtgggcgttgaccgccttcgtcgatcaggctatgcgcctggaaaacctgaggattgccctcgcaggttttgaagccgtgcagatgcccggtgcgcagttcgagtttcccggcgacgctctcggtgaggggccgcccgggctgatgaccgagtatctgtcacacgttaatgccaaagatctcttgagccttatcgataccgcaactcgcgacttgagacgccccatcagcagggagttcgccgaggaatgggtagatgaggcactggaggggcttgtccctgtcaacggacagtacggcagcactttgcgcaccacgattgccgaacggttgcagaaacgcctgcaaaaactttgcaaaaaaggacctcggccatgaattccaccaaggagaaggatgccttgctgtttgctgcgctgtccgggcctttcaagccaggccaggcactgacgacgctaaaagctgcgagcgggcctggggagttcgcgatggcggcgacccgtttggctgacttttgcgatacccgacccgccgatgcagaaggcttctggctcattcgcacaccagctcgccacgcacttctcgaagccttgagcgagccggcattggtcgcgggcgtggcgaaacggcgtcgtttggagactgatcaacaaacccgggaccttctcgccgtactgctggacgagccgccgctgtcacgcgcacagattgaggaaactctgcaaacggcgcgtgaacgggaggcattcgagcgcatcattcttgcgcttgatcgagcaggggcacgtgcgccgagccacgatctgctggcacaggcacacgcggcgctggtcaggttggaccgggaaaagaaaatggcgcaggttgccgagcgcggatttttcggccgagaaatggagtatgcgcgagtcgccgcatggctggactttcctgcgttggcgccgcctgcgagttgtctgtttctgagtggggcaccgggtattggcaagtcgacgctgttggcggagtcggttcggcgcacttacgcgcagcagcggccgttgatcttgcggcttgattttgaccgcgccgggctcgatgtccaggatttactgggcctgaccatggaggccacgcgacagctcgcagaccagatggatagcggcatcaaggagttgcaagacgctcgactcaaggccggcgaagtgttcgacaaggaaaaggccagccattcgacccatcgtcatgcgctgccaaccacccttgtccgccggttgggcgcggcggtcgcctcatcacggcgcccggtgctggtggttctcgatacgttggaggtgctgcgcagtcgcggcgaaacccatccggtcagactgttcgattggctcgacagtctgctggagcacggcgtgaagccaatgcacgtactggcggcggggcgcggtgacgcgctcgacagtgtgcagcgcatagcagacaaactgtcgaatagccgtccccgacaccttgagcatttcgaactgatggggctggatcaccctgcggccagtgagtttctgttcaagctcggtgcaccgcagcgctactggcgtgaattacttgaactggcccaaggcaatccgctcaagctgcgcttgggggctgaaatcgccaagcgtaccggcgacaaacgcttgccaaggcgtaaacgcggcgaagagatcagctcggcgttcctctacagattgctcctgtcgcgtatcgacgacccgctgctcaaacggctggcccacccgggcctgatcgtcaggcgtatcaatgcccaagtgattcgcgaagttctggcaccggcattgggccttggcaagctgaccattgagcacgcggaaaagctctgggaacaattggcgacgcagcactggctggtcgagcccgatcccggcgcaccggggtttctcaaacatcgcagcgatatgcgcgcattgttgctgcctctgctttacagctccagcgcggtcaaatcggcacgagtggatgcggcggcgctgcgctggtttgccaagctcgatcagccttgggctcaggttgaaacggtgtatcaccaactgcaactgactcgcgtgggaaatacgctgccgagcgtgcccagtcaaattgccgcgcagtttgatgaacagacgctggaagagttgccccgcccggtggctgacggcttgcgcgtcattcgcggcgagcgcaccagcgagttgcgtggagactggtcgaccggttcaccgggtcgcgaggcggtgatcgtgcgtgaaagcctgacgatactcaaacgtcaggactgggtggagggcgcatatctggcgcgcagcattgtcagtgagggcgacctggatgttcgctcaccggcggcagacgcggtgcgcatgctgctttggcgatcggggcagtgggctgaggcgaagcgctggctggcggagcgcgatcgcttcaccgactcagacgctgacgtttatgagttgccagaagagctggcattggttcggctggaaatgcgtgccgaattcagcccggatcggctgcgtcagcgctggcgggaatggcagcctggcatagaacgcctcgcccaggctgcggattcggcgagtgacgactgtgctcatcttggggcgctggcgttgttgatggacaatctgtccacgccttgcgagttcacttatcggcaaaaacgcaatggtaatttcgccgcagcagctcgcaatgtctggcttgacggttcgggcgacagagcagccggggcggtcgatttcggttatcagcgcatggctcgcttcatcccgcagaactctacacagaatgcattcgagaccggccgggtactcgccacactgacgccgtatgcgtctttcgccaaaaacctgatggtaataccgcagaatcgcgagttactcggtgccgccgagcgttttgccgatatggtcggccgggctggcgggctgattgaacagtggccaccagaacctgtacggatgaactccaacgaccctttggggacgttgaccgacataggtctttttgccgactgggcacaggccagtgcatttgtcggccgcgacgaaaacctcttgctgattggccgcgccgccgagcgctggcgacgaaccatggccggtaattggtcgatcgggcggcggtttggccgttggaagcagcgcccgttgctggataacaccgtcgaggcgcgcttgcgtttcctgctcggttcgaaaaatcctttgcaacaggcccaggagcagctgcgggtgtgggatgaaagcatgccctctgctgcgctgtggtcgttgttacgcaaacggatcaatgcaccattggttgtgcaaaaaggccagtctgcggatccggaattacctcgcgttattacccgtcaactgctgtcgcgcgcaatccccgcactattcgcgcctgcactgacagttttgatcctgcacggtgaactgtgaaacaggggaggttggcatgacgaacgaagagcggataaacaacttgaaagcgaagctgacgccagagatggaagcggcggttcaagaagctttcaatagcggccggctaccggaatcgctatggggcggattctccgacgcgagtcttgagtccataaaagccggtggtggccttgagccgatactggggcagggtaccccgggtaatttcgaggcgataatcaaactggtcgggcgcccatcaatgttggtcagtaatgaccgcgtggagctgcaacctttgccgaaattgccgccgcaaacctccaccttgatccgtggtgtcgagcagtggattccctcggtgggtcgcatcgagtttcgcaatcatcatatggcttggggcggtacaggctgggtggtagagcattccggggcgggcacgctggtcgtgactaatcgtcatgttgccaaactggtcgccctccgtaacgcggatggcaccggggtgttcctgcgcaacacatccggcatacgcatgggcgccgccatcgattttcgcgaagaagtccacagccaggtcggcgacaacagccgtactgtagcgctgaccaaggttcagtatctggccgacgatgcctccgccgacgtcgccttgctgttgatcgaggcggcagactttgccttgcctacccccatgcaactgattgaagacactgagtctgttcaaataaacgaactggtcgcattgatcggctatccggcctacgactcacgcaataacgccgatgcacaagcgaactacttcggccaactctatgaggtcaagcgcttcgctccgggtttgatcatgcagccgccaggcgccaatcaggtactgtcctatgactgcacaagcctgggcggcaactccggttcgccggtgatccgcctgagcgacggcaaggttgtcggcttgcatttcagcggggcttacctgcaggagaacagtgcggttccagcggcgcggatacgggaactggtacggggtctgcgtccggtttccgtgcagttgcaggcgcaggcgcaggcgcgcacgactgcactggttgaagccgccgatggcagccacaacgccgcctggttcagtcaacgaaaaggcttcgatacggcctttctgaaaactgctgagacaacgcagacggtcaaaaccccttggcccgtattgagcgcagatctggagctttctcttgccgtgccaagtgacacccccgagcaacccaatgagctgcgctacacccatttcggcgtcaagtattcagccacccacaaactgccattgatcactgccgtgaacatcgatggcgcggcagccgtgcggatcaagcggggtaccgacaagtggtttgccgacgagcgaattccccgggacattcaactcggggcgcaaaacttccaggacgaagagatcgaccgcggccacatggttcgacgtgaagacccgaactggggcagccagcaggaagccgaacaggccaacttcgacacctttcactacgtcaatgccgccgcgcaacactcgcggttgaaccagggcaaggcactctggcagggtctggaaaactacattcttgacagcgcacgcacccatggtttcaaggcctgcgtgtttaccggtccgatcctgcgcaagcaaggctcagaagagattgaagtatgtattgacggcgccattgcgccgctggagttctggaaactggtcgcgaccctcgatgctgagggcaaagcgttgcacaccacggcctacgttctgagtcagggccagttgttacgcgatcttctggagaaacgctcccggcacgaggcggtggaaggaatcgaactgggtccttaccgcacattccaggtggcgattgtcgatttggcagaggcgacgggttatgacttcagtgcctatgtcgccagtgacccgttgaccggcattcaggccggacaggaagccgttgcccacggcgagccagtgttcatgcaactcgccgagctgagcgaaatcattctttgaagggtaagggagcgagatgcctgagttaaatcaagctgtcgacagcgaagccattgacccgcaaagtcagccgccgcagccatttgcaaccgagtgcgatctggtgatgaaaggaggcatcaccagcggcatcgtctacccattggcgatcaaggaactgtccagcgcgttccggctgcgctccattggcggtaccagcgcaggcgccattgctgccgctgctgcggcggcggcagaactggggcgacagcgcttcgaggccgggctggtagccgccgaccccgagggtttcgtcaaactggccaaactgcctgggtacctgggttcgccgtctgcggacgggcggggcacaaaactctcagcgctgttcaaaccgttgccggcgctgcgatcaatcttcgatgtattgatggcctgtgtgtctgatcagcagcccggcgcacgtatcctggcggtgctggcgacgttgctgcgtcgtcattggttggccgcaggactggcgctgatcgtgggaacgctgcccctgtggttcagcgcatcgagttgggctgtggcgctctggcttttgggcttcagcgctttgctggtggcgggcaccctgatctggcgatccgcccgactgctttttcaggaactgccggacaatggcttcggcctctgctcgggcatgcccgaaaacgatgatccgcagaaagatgaagcgctgacccagtggctgagcggctacatcgatgatctggccggccaggcacaggcgttttccgggcaacagaaaccactgaccttctctgatctccaggcacatggcatcgacctgcagatgatgaccacttgtctgacgttgggcaggccttttcgactgccattcgatgatgacgagaacgtgcgcgagaacaaacagttcatgttcaggcgctccgagttcgccaagttattcccggcacacgtcgtcacctggatggtcgccaacgctcggccgccagccgaagatcaacggcgcacggacgctgccccggcagatgtcgacgatctgttcaatttgccagagccgggtgatctcccagtcattctggccgcgcgcatgagcctcagttttccgttgttgctcagcgcggttccgttgtactgcatcgattaccgcaagaagcttcagacgcagcagtacgttgcccctgagcgttgctggtttactgacggtggggtgggctcgaatttccccatccattttttcgatatgccactgccgactcgaccgaccttcggtcttgacctcggcgtggccgactcggcaagcgatcagcgggtcgtgttcgcgcaggataacggcgatgcacggctgacctactggcgccgttttaccgaaggaggcggggcgggatcgatcatcggatttttgtccgctgcgctcagtgtggccaaggactggaatcatgaaaccctttcacacctgccgggttttcgtgaccgtatcggccttgttcggctgaccgccgacgaaggcgggctgaacctcgccatgccgcagagccgcatcttgcaactgagtgaatatggcgcgaccgccgggcgcgagtttgtggcccgcttcggcgcgcctggtaaaacccttgaaatgaactgggaaaaccatcaactgatccgtttgcggctgctgctcgcatcgcttggcgaacaattgcagcatctggacaaagggctgcaagtgacagccggcacgacgggcgattacagcaggttcttcagccagcctgtcggcccgcaatcctatcgcttcacgggtcttggccaatggtcagcggaccccgcgacaggcttgtatggcagtcaggcaggattggccaagtggacgctcgagcaactgctgtcggtgccgcgcatggctgcggcaagccaacagacaacgcccggtacccgcctggacaagcgtgtacccaaacccttgccggagttgaagttgcgcccacgaatatgacctgatccgacctgcaaccgattgccgcaagcgccggtttcttcttcgcaacgcacgtagaggattgcaccgatgggccagcttgaactgcttgaaaaatggcgccgcatggctgtaaggctgcagattgaacacgaggtcagtgcgcgggatttcgagcgagtcagctggaaactgggtattccctgtgttgcgctttcggcagtggtgagcgccagtgtgttcagttcgatcaatgaccaatcgctggtctggctgcgttatctggcgggatttgtctcgatcctgaccttggtgctgagctcggtgcaaaccttcctgaatttcgagacgcgagcctcggcgcatcaggatacggcggagaaactgggagcgctggcgagggaaattcaggagcaactggcctctggcagcccagaaggctcgctggctgccgtggtgaccgatatgcgtaaacgcctggataccattttggcggacgcacccactctgcccaagtcgacgattcgtcgacttggcgaggggatcactgaccccgacaagcaaatgccggccacggtctaaacgttatcgaagttgcggcgcaggtcacgttgcacgctggctgacatgcttgggccccgccaatgcccaggcaatcaaaccgaacaacggcacaaacacgatcaacacaatccacacgcctttattgctcgatttcccctcgctcttgcgcacccgattgatggcccagagttcgattagcagaagaactgccgccagtacgatccacacggtttcgatttgcattggctacctcctgatggtctgttcgttaggtggcgcgtggtacggcgggttcatttatttttcttcaatgcgttgagttgacgggccagatccaaagcgacgcggccgctgttgaaggccggcagcaggtgggtgaaggggatttcgaggatgcgcttttcgcgcaccgcgcgcagttgtgacagcaccgggtcgtgggtcaacaggtagcgtttgcggcgggcgggagaccattcggcatcggcgagcaggatcacgtccgggtcgctggccagcagggtttcgcggttgacggtgactcggtacaggtcgatgtcggcgaacacattgcgtgcgccggcggcggccagcagcggcgtgacgaagccgcgctggccttcgctgtcgaggcctttgacttcgctgtcgagatagaacactgacagcggtttgcctgtgccggccaaggtacgggcgctggcgaggtcggttgccatggactcgatcaacgcttgggctttttgctgtcggtgcagcagcttgcccagcgtcagcaagtcattgcgcacatgcgcgaagtaatccagcgaatgcccgttgcaggccgattccagcagatacgaaccgacgccattgcgcgcaagggtcgaacgcgaagtcaccccgtcgccgaatgccgtggcaaacccgccgatcaccagatccggtttctgtgcgtaaagcacttcgctggccgggtattgccgcgcgatcaccggtacgccgaagtactcggatggccgttgcccggcatcggtgtcatccagatacgccacgccgaccagcgctggcccggcacccagtgccagcacgagatctgccgcatgctgattgagcgcgacgatgcgtgagggcgcagcggcgcgccagtcctcgccgcaattacggtaagtgtcggcgagcgccggtgtcgtgcagagcagggcacccaacaacagccacaaccggctcatgtccgcgccttgatcaacagatccgcgaccacctcaccgcccaccagatgcccctcgaccagccgctgtacatcttccttgctgtgcacgccataccagcagcgttccggatacaccgtcacgatgggtccttggttgcacggaaactgacagtgcgtgcgtgtcagcaagaccccgcccggcgtctcgatgcgatcatgcgcgagcaaatgccggcgcagggttttccataactgcatggcgccacgctgggtgcagcgcgggccggtgcagaggaacacatggcgcgcgtgctcgggcacgtgcgaccagtccgggtgcgtgtcgacgccgtcgacggttttgatctcactcatcagaagcggtacgtgtagcgcacttcggaggtgaacggccggccgaggttatcgacgttgctcgaacggctggtgacgtaatcgcgatcaaagaggttttccaccagcaggctcacgcggtgctggtgggcgtggtcgaggtagcgataggcgtcggcgtcgaccactgaatagttgccgtactcgacctgcttcgagcttttgatgtcgcgaatatagcggatcgcagcgccggcaccccacaggtggttctccgattcatagcccacacgagaacgggcgaagaaactcgaaatatcgttgatggtcacaccggtgcgcgactcggtgaggttgcgggtcatgtctgcttgtaggctccactgctcgttgagcgcgagcttggcgtcggcctcgaaaccgcgcatctggatcgtgccttcgccgttgacccactgaatgtcatcgagggtgatcagatcgtcgatcttgcgtttgaacagggtcacgctggcgctgaattcacgatccagcaggaagcctttgtagtcgacacccagttcggcgttgcggcttttttccggtttcaggttgcgattgccgatctcgtcgcccggctcgttgacgaacagttgctcggcgttcggcaatttgtaggcgctgccgtattgaccgcgcaccgaccagttgtcgttgaggtcatacagcgaagtgagcatgccgaccgtcgcgctgtcaccgccgcccatggcttcgtggcgtacaccgatgctcgggtgccagtcgggcagggcgtcgatctgcgggcgcagttgcgtgtagagcgcgtgggcttcggccttatcgttgtcgatgatcagcacatcgtcctggcccttgaaccactggttgtcgctgccgaacaccagtacatggccgccgggcagttcagccttgccttcggcctgcacgccccaatcggtgaagccccaatagtcgttgtggttgatgactttggtaccgccgccctcgacgttgttaacgcgggtgtagcgcgtgtcccagtcgttgatatggcctttgacgaagtagctcagacgctcagtgatggtctgctcgaaagtcgccgtggcgatctgctgtacgcggtcattggtggttgtgtggttgtccaccgggcgggcgaagtcgaggttggcgtcggcgtattggtagaacagctccagcctcgcgtcatcgccgaacgactgaatcgccttgccgccaaacgtggtgacttcgtaggcgcggtttttctcactgacgtttttcatgtcgcggttgcgatacggctgataaccgtcggagacgttgtggctgacatacgccaacaacccgagatcgccgaaaccgttagtgaagatattttcgacccgcgcatcttcggtggtgccgccgaagctgtcgacgcccagattcacctcgccggaggctttgcgcaattgcgggctgcgggtgacgatgttgatcacaccggaaacggcctgagtgccgaacaacaggctctgaccacccttgagcacttcgatgcgttcgatggcgttagccggcagggtgtccagatagaggccaccgtacaagcgattgttcaggcgcacgccatcgagcaggatcagcgtgtcgtcgttgcgcccgcccagcagcgaataagtgccgtagtcgaacggtccgtttttcggcgccacatacaagccgggaatgaacatctgcatcacgcggctgacatcggcactgggcccggcgcgttcaatctgttcgcgggtgacgatctcgaccttgctgccgaacttggccatgtcagcaaccgtagtggactccaccgacggtgcggaaacgatttgctgattgagttccagtggcgcgtcatcggccagcagcagagggctgaacaggcagccaaacaagagggttggagcagaagtgttgaaaggtcgaatcattgtcttctcgaaaaggatcttcgcagaagagcatgcaggagaaggcatcgcgcacagccaataccggcccatgcccgcccaccgcaggattttgccaaacgaaattccaggccggtctccgggctcgcgcgtatcgaggctttcaccttcccatggccgtgcggccacagtggtgtatcgaaagcatcacgcgcataccgttgcgggggcagcaccggacttgttcgaaaagaacgtaccggtttcccgtttcaccccatgcacggcggcatgggacacctgaaactgggcggcatctgaacattcgacagaccgttcgtcaacttgccggtgccgactctcgaaccgcgaattaccaactttcgaaataacaactaaggtctatgacggtaaccacaacgcaatattctgtggtgtcgacaggcgcgagttgctcgagaagcaatcgaacaaggaggttttcatgcatgctgcccgcgaccatgttcacggcgggtttgcctcgcacttcattcgcaatgccttgctggtcgccatggccaatgcgctggcgctgaccgacgcgcaagcagcatgcgggcctttggcggcgggtgcctacaacgtctcgcaaacctgcttgcctgcctccggtgtcgatgcgtcgatcagcactcagacgggcaccaccattaccaccaccgccggttcctcgctgaacagtcgtggcaacaatgccaacaccacgctgacactcagcggcaccacggtggacagcacgccacccacggccgccaacgcagtgtttgccaatgtcatcggcaccaccggcaacgccagcctgagcgtcaatggcgccaccaacacggtcaatgtcggtggcagtggcctcgatgcactggcaataaccaatgctggcgccgggtcgtcgacgttctcggtgagttccggtaccacgctgaacatcctcaacaccgtggtcggcaatgagcacgacggcatcgacatcaatgccagcggtggcggggcgatcaacctcaatcatcagggcaacggccagatcactttgcttggcggcaacggcatctggaccaaagccacgggcagcggcgagaccaacgttagtgtcggcagaggcgtgagcattctggtcaataacgatgatgcactgtcggccgggcttccgatcatcgacgacactttgcccaccgctggtattggtaaccatgccggtgtccacacccgggcggtgaatggcaacaccacactgatcaatgcggcgaacgtgcagagcatcggcatgaacgcttttggcttgttcaccgaaggtggcaatggcattacccgcctcaccaacagcgggacgctgagcaccagcggcctcaacggttttggcattcgttctttttccaccctcggcagcatcgccatcgtcaacaacggcgcgatcaccaccaccggcggcgccgcgcacggcatctatgccaacgacaacgtcggcggcagcggttcgatcagcatcgagaacaatgccaccatcaacgtcggcagcacggccaacaccgccggttcgcgggcgatctacgtgatcaagcgcggcaccggtgatgtctcgatcaccggtagcggcaatatcaacgtcctcggcgacatcaacaccacccgggcctacgcgatcattgtcagcgccgaaaacaacaatgtgctgatcgattactcgggcgacctgttcgccagcggtttcggcgcgggcggcattcgggtcgactcgaccggggggaatgttcaggtcaactatcgcggcgaccgtatcgaaaccctgcacagcaacgccaacggcatctatgcctcgacgcagtcgccgacgggcacggtcaacgtcaattccgccggcacgatcatcacccactcgaacgccggttcgggcgacggcacgggcattggttcctttggtatccaggcgctgacgctgggcggcgacgtgggtgtcgtgttcaatggcccgctgatcgacgtcaacggtcagggcgcggcgattctcgccggcaatgccttcaactcgggcagcgggctgggcacgttgagcgtcaacaacagtggggaattgatcgcgcgtggcaatgaccagcgcggtatccgtacgctgtcagtcacaggcgcccagactgtggtcaacagcggcgcgatccagactctcggcgccagcaacagtcagggcattctcgccgaggcgtcgggttcggccagtgtttcggtgagcaaccgcgcggcgatcaccacccaaggcacaggggcgtcggcgattgacgcattgaccgaaggaggcagcgccaacgtcatcaacacggccaccattgagggcgggcggggcgacagccgcggtgtcggcctcggtggtgcgagccagacactgaacaactctggcgtgatcagtgcgctcagcgatgtcgccgtacgcgccgatgcgaccacaccgggcacgacgtttgcgctcaacaacagcgggcaaatgaccggcgccgtgaatgccgtcagcgcggccagttcagtgaccaacagcggcacctggacgctgcgcaattttactgacagcagcggaagtggcactcgcgatagctggggcgttgccgtcagtgatctcggctcttcgggtgcgaacagcatcgacaacagtggtgtgattcgtctggcggcgcaaccggcgacgggcatcgtcaacttcaacgccagcggcgcctatctgcctttggggcaaacggccaatagcccaacgctgggcggtgccgtgcaggggcagttgctcggtgtaaaccgattcacccatagcggcacgctcgaccttgccgccggcagcaacacggtcggcaatgtgttgctgatcagcggggccaacaccgccggcaccgatggcggcggggtgttcgtgtccaatggcggcaggctgctgcttaacaccacgttgaatggcggcggcgcgaacagtctctccgacatgctggtggtggattcgacgaccaccgccagtggccgcaccaccggcgtgatcgtgagcaacgtcggcgggcagggcgagctgactcagggcaacggcattgcggtggtcgaactgctcaataaatccgaagccgcgagtgacgccaatgcgtttcaactggcccggcgtgtggtcgccggcccctacgaatatcgcctgcaacaaggtgccgaggatggcagcggcaaggacacttggtatctgcgttcggacgccgtgcctccggacggtcctcccggtcctgatcccgttccatccccggtgccgaattaccgcccggaagtatcgctgtacggcgccgttccggcgctggccctggtttacggccggacgatggtcgacactcttcacgagcgggtcggcgaggagcgactgaatcgcggtgatccgttgcccaaggaagacgaatccaccttggcgccgtcgatgggttgggggcgggtgatctaccgcagcggcaaacaggatggtgatcgcaaaaacgctttgggcaacaccccagaatacaattacgacctgacggcctttcaggtcggcaccgacttctaccgcaaggaccggcctgacggcagtcatgagcaggccgggctgtcgttgtccgccggcaccatcgacgccggcgtcagccactacacccggcgcgccgccggcgaagacactttgcgcgcttacggcctcggcgcgtattggacgcacttcggcccctccggctggtatctggacggcgtattgcagctcaaccgcttcgacatcgaagccaaacccaacgacctggccaaactgaaaacccgtggctggggctacaccgcgtcgctggaaaacggctacccgttcgaagtcgacaaggactggtacatcgaaccgcagttgcaggcgatctacagctatgtcgatctggacagcagcgatgacgtcggcgcgaagattcgcttcaaggacgtggattctttgatcggccgcgccggtgtgcgtatcgccaaggactgggacaccgagggcgtcgataaaactgcacggcgcaccaatgcgtggatccggccgagtgtctggcacgaattcaaggggcagccgaagaccgagttctcttccgagtcggggtacatcccgttcgagtcagacctgcagggtacgtggggtgaggtcaatgtgggggtggactaccaggccaatcagcgcaccacgtttaccgcttcggcgggttatcggcagggctttgatggcgacagccatgggtatgacgcgatgttggggttcaagatcaatttctagtcccgtgcatacaccaaagaagcctgtgggagctggcttgccagcgatagcggtggtttagccaccatcattgttggctgatctgactccatcgctggcaagccagctcccacaaggtttcgtggtatgcacaaaacccgtgtacatccttttcgccagactcttggatggcttgctgacgttcagccctatatccttcacgcctgtttgatggattgatttagggaagaattgcatgccgttcagggtgatggtggtcggtggttacggaaacttcggcagcattgtgtgccggcatctggcgctgatgccggacatcggcctggtgctttcgggccgtgatccgcgcaagttgcagcgcaaagtcgatgagctgaatggtcaatcgggcaatgtctgcgaaggctggtgcggcgatgccatgggcgtcgagttcaaagccgcattgcgcacgctgaacattcagttggtcgtgcataccggcgggccgtttcagggacaatcctatgccgttgcgcagagttgcatcgacgctggcgtgaactactgcgatctggcggactgccgcactttcgtcaacggcatcgacgttctcgacacacgggcgaagcaggccggcgtggccatcctcagcggttgcagctcggtgccgacgctgtcgtccgccatcatcgatgaacagcgccagcgtttttcacgcatcgactcgatcgaacatggcatttcctcatcggcgaaaatgccgggtctgtcgaccatcgaaggcgtgctcgcctatgccggcaaaccaatcaaacaactgaaaaacggcaaggtgcacgaagtgtccggctggctggacctgaccttgcgcaaaatgccgcagatgggcacgcggctgctggccaacgtcgatgtgccggacatggatattttcgccggtcgttatggtgcgcagaccctgaagttcaaagcaggcgccgggctaaaactcggcggcatcgccaacggtctgctggcccaggcgctgaaaatcggactggtgcgcgaccatgctttgtgggctgcaagattgcatcgattaggcacgcgcttcgagcgtttcggcgatggcaaaagcgcgatgtacatcgacgtgctgggccttggtgttgacggcaaaccgctgtcgatgaccgcgcaactcactgcaatgaatgacaagggcccggaaatccccagctgcgccgccgtagccctggcgacgaaaatggcccaaggctacgtgccgtcacccggcgcccgaccgtgcgtgggcgaaatcagcgtcgccgagtacatggccgcgatcaacgatccggtcaacctgagcctggccgtgaacttctcggacgggcagcgctgacatgctctatctgtgcctgaagtacctgcacatcatcgccgcgattttcctgttcggcttcggcatgggctcctacctctacttgattgccgccagccgcacacgcaacccgcaagtgattgcccacgtcgcacgcatggtcgtgggcttcgacacgtggatcaccacgccggccgggttcgtgcagatcatcacgggttatctgttgatgcgactttccgggctgagcatgagcaccgagtgggtgctgacgtcgttgatcattttcctctgcgtcggctccctgtggctgccggtgttgctgttgcagaagcggctgtgcgtgatggcatcaagtgcgagcgaggtgggggcggggcttgatgaacaatatcaattggtttaccgcaaatggttctggatgggcgtgctcggatttgccggaatgtttgtcatcgtgctgatgatggtgacgaagatgaccccggtgcagttgttcagctttctgctgtaggcgccgttgctttgaggaagcgctgttcatggtcaggcgtgggcagcaggcaggtgtcgtatttgccgaacaggcgatagcggttcagcgcaatgcggtcgtaagcccagtcgcgcaggccccgggggaagatgcgcagcagtcgcaacggctgccagcgggcgggcaattggctgatgatttcgaagaaagcgttagaacgttcccagtagtggcggtcgcggatgaccgccatggtgtcgaattgatcaattggcagaccggcccacgccagaagcgcctggccttcgggagattgcacggcggccagacgtacgcggcgttggtggtcgtggcggataaggaaccgcgcccagccattgcagagcttgcagacgccgtcgaacaggaccacggattcgccggggttgaggagcggggcgggggttgggcgggggtttgaactcggcatggggtttgtgttcaagagcaattgtggtgtcgcaagcatagacttaagggagccgttcgtgaatgtctcccgcctcagccgacgctgtgattagacaaataagttaagtcgcttctttcggtgttttgcgcatcactcatgagcctgactaaagaattgagctttggcgggctgaagggcagccacatccggagcgcgatctctattgaacaggttctttttactcggaattagatgatatcattgcgccatacttcaaggagggtcagcttaaatgtgcaaagcgtttttcgttattcttgtaatcggtactatcacggggcttacctatttactcagcaaaaaaaatggcggcgatattcgggtggtgtggtacttgtctgcgctgaccgcaatgattgtattttttgtagccaagattgcgattggtacaggcgttatcgtgggtgatgaatttgttggtgaatatggcaagttgctcagccactttaccggcatcatgctcgacttcaaaaaagatttcctgattgtgacgtgcattgccagtctggtcttggttcctcagttcatttgttacctgctcagcgggctatcgggtaatgcgaaacccccaatgttgatgggtatagttttgtcgttttttttctggggaattatcaagtcgttggtcgtttgcgcctcgattctcatgaccctatggggtttgtatttctttggttatataccgacgtcagatgaaaccagctggtttttccttaaagccgggttgtcctttctgttgctggcattcggcatcatttccctatatcgcgaaggtgaacagcttgctaattgggtaggtgagcatgtgccgaagttgagagcaattcataaatgttttacccgtaacgagaaagcttcgagctctggagaggcggtcaatgcagtcgacgtgctcgaattgtctcagtcactgatgaggctaacgtccgacattcaccggatcgcgctcaaatacagagagtctgcaaaaggcagcaagtaatcgtttgtcgcttgatttcgcctgccgtgcatcactgtctgaccctgtagtcgaggccagtgaatctcaggggcagagcactttcgggtggaatgtgggtggaatggggaccaggtggaatggggacagatttatttatcagactaaaaaagggacagatttattttcagagaataaatctgtccgctttcttcgtcccctttcttcccggataaacatcaacccgatggaactgagtacttcgacggccagcttctcgaagctgtgcagcgcgcacagtcgacagattagtcgtcattgattcataacaatctatttgtctggtacgcatatgggcatcaacctactgaccgaatccatgctgggccactggcgtgctccctcagggaactggcaatgcgaattccagttcggcactcgattgatttacgtcgaacaccacaatgacgaaccacctcgcgccaggctcgtcgctgcgcaacgtatggtcaacgccgcgtgggatgatttgccccaagtattgaagtttgccgaacagcactgcaaagcaaagatgcccgagctgatgcggttgtatgaaacccggatgccttgggagtctccgttgttcgtgtactcgctccatttcgatatcgataagccttatccaagttatgctatttccaagaaccccgacttcgattgggattgcatcctcatcgatgaagatgaatggtgccaagaacacagtgttcgcatggagcaatatgatccaggggatgattattgggtttacgtcaggcgcgtggggtatcagcaattcgagcttgtggattagcttggcgattgactatgcgagagtgtcagattcgaccgtcagctttcggccaattgcggcccatcaattaaaggcgcttttgtccgaaaagcaccattcaaaaatatttgaagcacgacgcgcaggcaccgacctcaaggacgatgtagccctgtcgcatcccgccagtacatggtttgttcgaactgaaagctaactagaaagaaggctgaacacgactgagatattgattgggcgactttttccaaatcttccatagccgactctccctctggttcaggccctttaattctgatggtacaacgcacagcgacaggaaagtcgatacccattgtattctcagcataaatcgtgtggtcaccgaaggcgtcatcggtacttaatttaagtcctgagctaaattcagcgtatagcccatcttctgttacctcgacttttcgagcaccagcattctcaagtgcattgctcaatgtcaaaattgtgagcgtactgtcagcttccaaacatagatcaagactcatcaattctccctttttcccgcagaacacttgcaccaaatttcaatgcaaccgtcgcgacagtgtatttgactagcggtatgaatgtccgcttttggccgaaagcagacgcccaatgcaatcttgatccctttgtgacagcaacccgactgccgccacaaagggatgtccactcaatccaccggcacaactttatccagtgctttattcaccgccagttcccccagcatcaccacttgcgcaatccccagcgcagttttgcggtggcctgggtccaggagggcggcgaagttgcagagcatctcggtggctgagctgagcgattcgctggcgttaacgagcagggactcgctgtcgtagtcggagttggccagaaacatgggaacgtgttttttgtcgctgcccatgatgcgctgggttggcgtcaggtagtagtcgagggcgcgttcggcggcttcgtggaatttcctggaatcgggagcttcgtacggggaggccggatctgtttccggcgggttcggcgtgatcttgaacatgttcttctttttcctgtggtgtggccgccgcaccgagctactaaacaggggggggggcagctgtacgcaggttagtagaccggggaaaagaagaaagccggcgcgcccgagggcgccctacgcacagccgccatcgagtgcaggtacgcaaataccttctgatggacgcttgagcactttcatttaccacgggctactaaacccgatcactgggaatcagtgacgcgaacaaagttaccggtggcctttgaggcgcacaagccggcggattctggcgcagtcgtaggcaatggcgcaagaagttgtagcctcaagcaagtaacgcgacgtgtcttttaaacaaccacaaaaaaactcctaaacacgcctcatcaacacgccgttcaaaatgacattcgtcggcccgccctccagctcaggcaatggcctggaaccctcacgcccgggcacgcaccaacactaggttgcaacccaaaaaagacgaggagggatacccatgtcagttcatccgattttgtttctgggcggatccggcgccatcggccatcgttctgccaaagccctgcgcgctgtccaccccgacgtaccgttgctgatcggcggccgcgacctggccaaggctcaacaagccgtcgaggaaatgggcggggagcagggcgtggtcattgatcctgcggccgatgatctgggactgggcgatcgcccggtcagcgccgtggcggttttctacatggatcattcccttgccgggttgcgtttcgcgcagcagcgcaaggtgccgcacctgagcatttcgtccggcattttcgagattgcgccgcaaatcgccagttacatccatcgccctgacgcatctgccatcgtgctgggttacgagtggatggtcggtgcaacgacggtggcggcgctgcacattgctgaggcgtttgcccgggtgcgcgatattcgcattgatgcgttggttgacgagcaggacggcggcgggccgaccgtggccaaagattttgaacacttgagcaaaatgctgcccgccgccctgacgcggcgcgatggcaattacgtctggcgtgaaggtgaggagcagaacgtcagcttccgtgcgctggacggcacgtcgatgcaagcctctggcttctcgtccatcgatgtgaccgggctggctgccgccaccgatgcgcccaatgtgcagttcaatctggccagcggggtgagctcttcgcgacgcgcgggtcggccgatgtcgaccgagatcctcatcgaaatggtcggcgaggatcgcaagggtcgggcgttgcacacacggcatgccgtcgttcacccggcaggcgccgcagcgttgacagggctcagcgtcgccatgttgttggaacgactgcttgggctggatggcaaactacccacttcggcaggtctgtactttccttatcagctgctcgatgccggtgcgtatctgaagcgtttgagtaaagagggcggtgagctgctggaattgaaagtgcactaaggcaagtttctttcgttaatgctgaccgttctgatagatccgctggcgagccttgatgtgctcgccagcggccctttgccctcacggcgactgccaagccccaccatctgccaccggcacctcacccagatcataagggttgaccccttcaagacaacccacattgaaaccaaactcatgcggattggtactgcgtcgatggtgggtgtaaataccgcaattcccgcagaaaaaatgctcggccacttgctggccaaagctgtacttcagcaatgcagattcaccgcgaatcaccttcagatccgccgccggcaccgccgccacaatcgcacctcggcgtttgcagaacgagcagtcgcagcggtgcggcgggggcaggccgtcgggcaaatggatttcgaggatgaccgcaccgcaatggcaactcgcgcggtggtcgcgacggatcagcgtgttgccgacttgtttgagcatgactatgcctccatccagtccaccgttgccgtttcgcgccatttcacgtcggtgatgccgaagcgctcggcctggggtttggagatgactttcaacggtggtttgccgggtttgggaatcggcgcgatgccggcatcgcaactcgcccaatgccaggcatcggcattgcgcatggtttttgcgcggatgacgaatgatcttggctggccgtgaagtttgtattcgatgacgaagatgtcgacgttgctcatgagttcctccttacgctcatacgcaaatgagttttgccgacgaaaaaaattcaaaggattttgcgctgtttgtttttgctggggtcaggcacccgaatcaagcaggcgctgcgtcagcagaagattttttgaacactgtttcgttagcgcagcccaatgcctataggtctcggaggagtgcgccatgaacgaggcaaggtcctggggctgatcgtgtggggtgttgccggcccacgcgggatcaagcaaggcccctcgtcaccggagcacagcaagggttgagtggtgaacaaaacgatcaatgcgcaggacctgaacatccgacttcggcgcaacgatgaagacggtctgttcaaatggttgcttgccagtttcttgatgggcaagcgaatacaggccgaaattgccgcgcaagcctatcgggtgatcgtcgatcaacacggccgcgatacgcctcgcaagctcgcgcattgcagccatcgtgaattggtggcgatgctcggggaggcgcattacgtgcgttatgacgagaccacggcggagcgcctgctggcgttggcacgccggcttaacgacgaatatgcgggcaaggtcagcaatatgctggaggcgagtactgaccgtcaggctttcgagaaacgcttggcggaatttgatggcatcggtccgaaaaccgtggagattttcatgcgggaggcgagtgcggtgcttttttaatcgactcggtgacgggttacctttcctaaggagaaggtcatgaaaaagatatgcgcatgtctaggtatttgttcgatgtttttattgcagggctgctttgaaagcccgcatgactcacccaacaaggacggtgacaagagcaaggcctcgttgcagatgcagcagggcaaaaccgacgagagcaaatagccttcagtcgtggcgagagaagaatttcgcaaggagatgcggctgagtagtgttgcaaatttcgggcagtggccaaactctggtcactgcctggatcatttatcagctacctgactcgcccgcgagcgcgattgatcgacagcaggcaaatccccaccagcaaggctgcgcctgcaaccagtagcgcagaaggacgcattggctggggcgtgccgtgtgtacgccgctgggagagcggcattgcacgggtttgagtgggcatttcgtcgagcgtccggagtggcgcgacggactcttcctgatagggcacttcctcaatactcaaacgcaggccgtctttcagctccaatgtcagtgcggtgatcttgccgacgattctgtccggataaaccggttcgccattgggatcgagttggtcatacaggaaattctgcccttcgagccagcccacggccgtttgcaactcgggacccaggtaatacttgccgtcgaggaaaaatccggggaattgcggcgcgcgctcgacgctttcaatgcgataacgctcacccggtttcataccggtttcaggggcaatcatggtcaatccctccgctgtaggttcagcggtagagaacaaggatcgactgtcgttccatgtaaaagaggaaaggtagcggttgtcccggaacggatctgtaacaggcgaaaacaacttcgcccgaccaaggccgggcgaagcggtgtggcgctagctcaatcagtaatcccagatcgccggaatccagcggaacgcctcgccattgacggcaacgcggccgaccgacgggaagggcaggtgtgtggcgacaaacagttcgccactggcggcggcttcctgcagcaggcgcacgcgcacgcgcaccgcttcatccgggtcgtgctcgaagccgttgtgccagtccgggtggtcgaaggccaccgggaacagggcgtcgccggcgaaagtcaggcgttcggcgccggaggtcacgtagaccacgcagtggcccggggtgtggccaccggtgattttggcgactacgccgggggcgacttcgaacgcgtcttcgaagatgcgcagcttgctttggtactgctggatgaacgcattggcggtcgagcgcagcacgtccggcaccggcgcgggcatgtcggtgctggtgaagtccggcgaggtccagaagtcgacttcggtggcggtgacgtggatgcgcacgtcgtcgcgcaagcggtttttcaccgtgtcgacgagcagtccgccgatgtggtccatgtgcatgtgcgtgatgacgatatcggtgacgtctgcgaggtcgatgccggccgccgcgaggcgtttgggaaactgcccggcgcgggggaaaccggggaactggccgccaagtccggcgtcgacgaggatcacctgttcgccgctgcgcaccaccagcacattgagtgcccagtcgaacgcgtcggggcccaggtacatctctttgaaccactcagcgcggtcggcaggatcggcgttggtcgacatggtctgggtcggcagcggcaggacgccatcgctgattaccatcacgtcgatgtcaccgaggcgcagcgcgtagcgcgacggcaccagctcttcggtcggggtttgcagggtggcgctgttggcggtgaaggaatccagatgcatggtcatggtgttctcctttttatcaggcaagacatcggttcttgggcgctcggggcagatcaggccaccggaatcgccgggtcggcagcggccagagcggcgctacgctcggcgaccggcgggtagatccacacgctgttgatttgcgtcttcagttccttggcttcgtctttcaccagtttcagctggcgatcccagccctcggtgtacaccgcgccccaggcacccaggtcgaggcaggtgacgtacttcggttgacggtatgtggtcggcgcgactccgagcagatcggcgatggcgttgttgccggcatgacggccgaggctgatggcgtgctggcaggacatcaccgagaagttgccgacgtcatcggtggcggcacgggcgacgtcaccggcggcgaacacgtgctcaaggccttgcactttgaggttgccatcgacgtgcaaccgaccctgaccatcgcgctcggcgttgagctgttcagtcaacggactggcgcggaaacccacggtccagatcaccgtgttgctctcgatgtggcgaccgtcggcgagggtgacgccgttggcatccacagcagcgaccgtggcgtcgacgatccattcgatgcccagctctttggacgcctcgatgatggacggtcgaatgccgtcgcccatggtcgcggcgatgtctttgctgcgatcaacgatgatcacccgaacgtcttgtccttcacccagaatggcgcgcagacggctcggcatttcggtcgcggtttcgatcccggtgaagccacccccggcgatgacgacggtattgcgggccttgctgaccggttgactggccaacgaaatcaggtgacgttccaggcgcgccgacgattcgatctggtcgacgtcgaacgcatgttctttcagacccggcactggcggacgggccagttggctgccgctggccagcaccagtcgatcgtaagaaagctcacccgggcgaccgctttcatcgcgataaccaacgcgacgtgcctggccgtcgatgctctcggcggtgcctttgacgaaacgcacaccgaccgcagcgaacagtgcatccagcggcgcgtacatgttgtgcacatcgggttcgtagaaacgcgggcggatgcgcagttcggcttgcggggcgagcagtgtgatctccacgtcgtgacggtcatgcatatccagcaaacgcgcggcgctcaatgtgctccacagcccgccgaaccctgcaccgatcaccaataattgctgtttcataatgtgctccctgacgctgatgaatggataaacccgagtcgttttcgactctggcgtgacgttactggccgccgcaaactgcttgccgtactgcatggcgcttaatcgcccgctgtcgaaaacgatgttatggcgtgggggctgcgggcgcagttgtccatcggtgtgcgtcgattacgcatgcgttgaaggggggtatacgaaggtatcgaacggtaggagctgccgaaggctgcgatctgttgatcttgtttttaaaaggcaacatcaaaagatcgcagccttcggcagctcctacacgggaggggttctattcagggcttgtttgatatggctgagcaagtcatcggcctggaagggcttgggcaggcaagccaccaccccggggactcgggtgttcacgtcatcgggatgagcagtgacgaaaatcaccggaatgcgccagccttgcgcgtgcaacgcctcattgagttgcaggccgctcatgccgggcatctggatatcggaaatcaggcagtgcgcctgctcgggccctgttgattcaaggaaggtgcgggcgtcgggaaaggtccgtacccgataaccgctggcgcgcaacaagctttccagcgcactgcgaatggcctcgttgtcgtcaaccactgcaatgacaaccgtgttgtgcatagggctccctgaccggatgggcatgcgtgacgactcctgtcgttcttgcaccatacgccgtccgcgctggggcaaaactatacctaggtatagcgcgtcgagaccctttgatagtcagcgcttccggcgatcagccttcacgagtgaagcgactacggtaatcacgcggagaaatcgacaggtgacgctggaagcaggcgcgcagacgctcttcatcaccgaaaccgcagaggcgcgcgaccttgccgatgttgtgcgccgagttttccaacagacgcttggccgcttcgaggcggaacagttcgatggctttggatggcgtgcggccggtgttctgtttgtagacccgggtaaaattgcgcaggctcattctggcctgctcggcgagacgctccacactcagtttgggatcgccgaggttgtccatcagccaaaggtgcagcggctcgaacaatgggctgtcctgcacctgcgcttgcagcaacgtgctgtattgcgcctgaccaccgggccgcttgaggtacaccaccagttcgcgggcgacctgcaaagccacttcgcggccggcatccgcctcgaccagcgccagcgccagatcgataccggccgtgacacccgccgatgtccacaccgccccttgctggatgaaaatcgcatcggcatccacttcgatcgtcgggaagcgttcgcgcaacgtctcgcacatggcccaatgcgttgcggcgcgacagccgtcgagcaggccagccttggccagcaggaacgcgccgctgcacaccgagaccacgcgttgcgcgctcggcgcctcgcgacgcagccagtcggtcagttggccatgctcgttgagggactggcagatgtccggggcaccggggacgacgagggtatccagtgcggccatgttcagatcgcgtagcgcgcgggtgtcgacggccaaaccttcgacggtgtgcaccaagccgcctccaaggctggcggtgtgcagctgataacccgcttgaccgcgttcggccattgctttgctcgcggcccagaacaccgtttgtgcaccgctgaggtcgagcaggctcattcgcgggtaggcgatgaaaaccacgtcgcgtgattgcgcggtagaagtgccgggctgcggggaaacactggacatcgaaatctgcctgttcaatcggctgaagcggggcggttacggcatggccgatattcagggttttctggcctgtcggcaacgcgcgccgactgctagcctgctgcgcgaccgtttggctggcatctggctgcgtttgccatcatggactagatttattcacctgcacatcgcacgcgttgcgatctcgccgaggagacagcatgaccctgtggtcgcattccagccccagcaccaccccgccgacgttgcgcgagccagtggtttatgtggtcgacgacgacgcctcgatgcgccaggccctcgacggtttactgcgctccattggcctgcaggtgcagaccttcgaaacctctcaggattttctcgccgcggccaaacgtgacgtgcccggttgcctggtgctcgatgtgcgcctgcgcggtgaaagcggcctgacttttcaggagcagatggaaaagaccggcgtgcgtattcctatcgtattcatgaccggtcacggcgacatcgccatgaccgtcaaagcgatgaaggccggtgcggtggactttctcgccaagccgtttcgcgatcaggacatgctcgacgccgtcgccagcgcgttggcccgcgacagtgcgcggttggttgccgagcagtctggtgcggttatacgcctggcctacgagacgctgaccgtgcgtgagcgcgaggtgctcagcttcgtcatcggcgggctgatgaacaagcagatcgcggcgcagctcaacctcagcgaagtgacggtgaaagtccatcgcagccaggtgatgaaaaagctgtcagcccgctcagtggcggatctggtgcgtatcgccgaagccctgggcatcgagccggcgcgccgcaacggttgaacagcaaccctatgacggtgtcgacacagatggccagcaaaaagcagatgttgtgggacgacggcgagcgggtgtttgctcgcgaactcgaccagagagagggtcgtcgcagtgttctggtgatgcgcccggcccacgctcaaccgctgcccgcgacccttgatcgcctggcgcatgaatacagcctcaaggacgatctcaatgctgaatgggcgctgcaaccgcaagcccttgaacgcgcaggcgcaacgacacgcctgttattcgacgatcccggcggcgagccgctgtcgcgcttgctgatcgcgccgctggacaccgagaccggcctgttgctggcgatcaacatcgccgtggcgctgggccgcctgcaccagtgcggtctggtgcacaaagatctcaagccgcaacacatgctggtcaattgcagcgacggccaggcacgcctgaccggcttcggcctcgcctcacgtctgccccgtgaacggcaagcgccggagccgccggaaaccatcgctggcatcctggcctacatggcaccggaacaaaccgggcggatgaatcgctcgatcgattcgcgcagtgatctgtatgcctttggcgtatccctttatcaaatgctcaccggctcgctgccgttcagcgccaatgatccgatggaatgggtgcattgccacatcgcgcgcttaccgatgccagcgtgcgaacgggtggccaccgtgccggcgatgctctcgcgggtggtcatgaagttgctcgccaagaccgctgaggaacgctatcaaaccgctgccggggtcgagcatgacctgcgccgttgcctgaacgattggcagcgtgcccggcacatcgagactttcacgctgaacgagcagggcgcgatcgatcgcctgttgatcccggagaaactctacgggcgcgagcgcgaagtgcaaacgctgatcgatgcgttcgcacacgtagtgcagagccaatcgccaaaactggtgctggtgtccggttactcaggcatcggcaagtcctcggtggtcagcgagttgcataaagtgctggtgccgtcgcgggggctgttcgcctccggcaagttcgaccagtacaagcgcgatattccctatgcgacgctggttcaggcctttcaaggactggtgcgcacgctgctgggcaagcgccgcgaagtgctcgttgaatggcgtgcggcgcttttacaggcgctgtcaccgaatgcgcggttgatgaccgaattgatccccgaactcaagctgattatcggcgagccaccaccggtgccggagcttgaaccgcaacaggcgcagcaacgtttcatgcgagtgttgcagcgctttatcagcgtgtttgcccgaccggaacacccgttggcgctgttcctcgatgacctgcaatggctggatgcggcgacgctggatctgctcgaagaactgctgacccgtgccgaggttggccacctgctgttggtcggcgcctaccgcaataacgaggtcgatgccgaccatccgctcagcagcaaactcaaagccattcgtagtgccggcgcgcacatcgacgagattcgcctgaccccgcttgccggtgtgcacatcgaacaactgatcgccgaatccttgcgctgcccacccgcgagcatcgtcaccctggcgcggctggtgctggacaagaccggcggtaatccgtttttcgtcatccagtttctccaggccctcgccgaggaggaactgctgatttacgaccatcaattcaaccgttggcgctgggatctggagctgatcaacggcaaaggctacaccgacaacgttgtcgatctgatggtcggcaagcttgcgcgtttgccactggaaacccggcaggccctgcaacagctggcgtgtctggggaacgtcgcgcggatcgacacgctggccactgtgctcgatctgtccccggctcgcgtgcacgcggcgctgtggccggcggtgcgccaggatctggttgaacgtctggacggtgcctgtgcgtttgctcacgaccgtgtgcacgaggcggcttactcgctgatcgccgaagccgaacgtgcgcagacgcatttgcgcattggccggctgttggcgctgcaaacgtcggacgaaggccgcgaagaggcaatctttgaaattgtcggccagctcaatcgcggcgccagcctgatcagcgcccgtgccgaacgtgagcagttggccgaattcaacctgctcgccggtcagcgcgccaaggcttcgaccgcttacacctctgcgttgacctatttgggcgcgggcgcgacggtgcttggcgaacaaggctatgacagccgccatgagttggcgtttgccctggagctgaaccgcgccgagtgcgaatttcttaccggacaattggcgctggccgacgcccgactgcaggttctggccgagcgcgcggcaaccacagtggagcgcgcggcggtgacgtgtctgcacatggatgtctaccttttgctcgatcgcagcgaccgcgcggttgccgtctgcctgtcctatctgcgccaggttggcatcgactggacggcacatccggacgatcagcaagtgcgccgggaataccagcagatctgggtgcaactgggcgaacgcagcatcgaacaactgatcgacttgccgttgatggaagatccggcctcactggtgacgctggatgcgttgagcaaactgttcgcaccggcgttgcagtcggacgccaaccttgcctgccttaccatttgcaaagccgtcagcctgagcctgcaacagggtaattgcgacgcctcttgcgtgctctacgccaacgttgcccgtgtcgccgggcggcgcttcggcgactatgccgctggctaccactttggccgtttggggtgtgatctggtcgaccgccgcggcctgacacgctacgaggcgagcacttatctgtgcttctcgatcttcgtggtgcgctggatgcgcccggtgcgcgagtgccgcgaattgctgcgccgtgcacttagcgccgcgaaccgcatcggcgatttgccctacgcggcctatgccggcaacagcctgatttctgacctgctgtttattggcgagccgctggcggaggtgcaggttcaggccgaggcggggctggcctacgcgcagaaaatccgcttcgggttggtggtgagcttcatgagttgccagcgagcattgatccgcatgctgcgcgggcagactgtggaatttggcagtttcaacgatgaacaatttgatgaaacgcgcttcgaggcgaaactcgctgcgcctgatctggcgttggcccgtggcaaatattgggtgcgcaagttgcaggcgcgctatctggccggggattacgcggcagcggctgattgcgcggcccaggcccgggaattgatgtgggtaatttcttcgtttttcgaggaggccgaataccacttctacgcagcactgacgttggctgttcatagcgacgccgataccgatccactgcaacgcttggcagagcaccacgatcaactgcaaatctgggcacagcagtgtgccgaaacctttgtcagccatgtggcgctggtcggcgccgaaatcgcgcgggttgcggggcaaatgatcgaagcagagttgctgtacgagcgggcgattcaattggcggtggatagcggttttgtccacatcgaggctttggccaacgaactggcggcgcgtttctacggcgctcgcggtctggcgaaaatcgcccgcgtctacctgcaagacgcacgctacggttacttgcgttggggcgccgatggcaaggtgcggcaactggagcggcggcaccgttttctgcgccaggaagacgcgcagccgagcgcgactgcgaccatcatcaccgccgttgagcatctggatctggccacagtgctcaaggtgtcccaggccgtgtctggcgaaattgttctcgaccggttgattgaaacggtcatgcgcaccgccatcgaacaggccggcgccgagcagggtgtgctgattctcaccgaaggcgagacgccgtatatcgccgcgcgaacgcgcattggcgacagcgccacattactgtgcaatgagcccgtcaatgccgcggcgctggccgaatcggtgctctaccagaccctgcgcaccggcgaaaacctatgtctggacgatgccgtcgccgatccggcattcgccgccgatccctacatgcaccagcacggcgcccgctcgattctgtgcctgccattgatgaatcaggggcgggtcgccggcgcgctgtacctggagaacaacctgtcggcgggggtgttcagcccggcgcgtattgccgtgctgcggctggtcgcttcacaagcggcaatctcgctggacaacgcacggctgtatcgcgacgtcgccaagcgtgaagcgaagattcgccggctggtcgacgccaatatcatcggcatcattgtctggagcgtcgaaggggaaatcatcgaggccaacgacgctttcctgcgcatggtcggctatcaacgagatgatctgctttcggggaaagtgcattggcgcgacatgaccccaccggctcggcgcgccgaaagcgaagcggcgctcgcgacggcgatccgcaccgggcgtgcccagccgttcgaaaaggaatacatccgcaaagacggcagccgcctgccggtgatcgtcggtctggccgcattcgaagccagtcagcaacagggcgtggcgtttgtccttgatctcagcgaacgcaaacaagcggaagaacaagtacgcgaaggcgagcgccgttaccgccaggtacaagcggaactggcccacgccaaccgcgtggcgaccatgggccagctggcggcgtcaatcgctcacgaagtcaaccagccgatcgccgccaccgtgaccaatgccaacgccgcgttgcgctggctcggcgcacaaccaccgaacaccggtgaagtcgaactggggctcaagcgcatcatcaacgatggtaaccgcgcggccgacgtgctcggtcgcatccgcgcgctgatccgcaagacaccaccgcaacggcaagcgctggatctcaatgcggtggtggaggagatggtcgggtttacgcgcagtgaggcgactcgatatggggcgatggtgtccgtgcaactggccagcgacttgccggcggtattggccgaccgggttgagttgcaacaggttctgctcaatctgatcgtcaacggcctcgaagccatggcggtgatggcggagggcgtgcgtcggctgtccatcaccagcgatgttgccggtggaaacgtgcggattaccgtcagcgactccgggccgggatttgcctgcgagcgcgcggaagaagtcttcaccgcgttctacaccaccaaacccaccggactggggatgggcctgtcgatctgccgcacgatcattgaggcgcatggcggacgcttgtgggcggaggcgaatgcgccttgtggggcgcgggttgtgttggcgttgccggggtataagcaaagtcctttcgccgaaggcggatgcgattgagttgccgagttatgaggcactgcagcgaacataggttgcaatgtgcgcgaggtgaccagtcggtgtttatcgtgaacacatagttctcgaatgtcgatatcagacacgatcatggcgcaatcaggctactgactcatcgggcaggccgggtaaggtgaggtgtctttaagtcaagataacctcataaagatcatggggttgataagaactgcggcggttgaagggggcttctttcgggaagtcctgcaggcaacgatgatgatcgtttgcccgcatcaattagcttgaatgtcgatcagcagagaataaaaaaaccaatgatcagccctaactccatggattcgagtagccaattggcgcagggcttcaagcctcgtcacgtcaccatgctgtccatcgccgggatcatcggcgccggtttgttcgtaggttcagggcatgccattgccgcagcggggccggcggtgctgctggcttatctgttctccggtttgctggtggtgctggtcatgcgcatgctcggcgaaatggcggtggccaatcccgacaccggctcgttttcgacctatgccgaccaggcgatcgggcgctgggcgggcttcaccatcggctggctctactggtggttctgggtgttggtgattcccatcgaagcattggcggccgggcatgtgctgaatcaatggtttccacaggtggatgcctggttgttcgccttgggctcgatcattgcgctggtggtgaccaacctgttcagcgtgtccaagtatggggagttcgaattctggttcgccatggccaaggttgtggcgatcatcggttttatcggtgtcggttttgcggtgttgatgggctggattcccgacaggcaagtcagcgggttgagcgggttgatggccgaccacggcggatttgcgcccaacggtttgtcggcggttgtcggcgccttcatcaccatcatgttcagcttcatcggtactgaagcggtgaccattgccgctgccgaatcgaatgatccgtcgcgaaacattgccaaggccacgcgctcggtgatctggcgcatcggtgtgttttatttgctatcgatcttcgtggtgatctccgtggtgccgtggaatgatccgttgctggcctcggtcgggtcttatcagcgcgctctggaaatcatgaacattccccacgccaagttcatggtcgacatcgtcgtactgattgcagtggccagttgcatgaactcctcgatctacattgcctcgcgcatgctgtactcgctgggccggcgaggcgatgcgccgaagatgctgaaggctacctcctcggcaggcgtgccccgagcagcggtgattgccagtaccgtgctcggcgcgttgatcaccgtgtggagctatttcatgcccgccgggctgtttcaattcctgctggccagctccggcgcgattgccttgctggtgtatctggcgatcgcggtatcgcagttgcgcatgcggcggattttgcgtcagcgcaatgtcgagctgacctttcgcatgtggctgtttccatggctgacctggctggtgatcgtgttcatctgcgcagcgctggcggtgatgatgatcaccccggaacaccgcaccgaagtcaccaccaccatcggtctggcgttggcgatttcctttatcggcctggtgacgtcgcgtcaccctgcgccggcggcgacggtcacgtcggtggggtaaaaaatcggcagctcattgcgctgaacctttcgctggcgcccggatttgcgtcaaagcctgaatgacattggctgccattttttcaggactgatcgtcccgtccaatcgcaacaccgaggccgtttgcgctgataaccacgcctcgtgccaggcgcgattgcgtcctgaaaagtccggattgtcgtactgcgaggcccattctcgaaaggcggcatgtatctcatgcatgtcgccacccggtgcaatccgctctccaaagcgttgcttttcccgtgccgccagccgttcgaggcgaacggacgttggtgtgacaacgaacacaatcagatcggcatgggcaatcaacgcatccccccaatcaatacaagaacccgtcagcacccaatcgtcgtcaccgagttcttgctgcatcaatgaaacacgctcactgaccgaacgcttggttgtgaacggaggattggtaggcatccagaagaaatcgtcgacatcgacctggcgtatgcccagtagaagggcgaggtgctgacccaaagtcgtcacgcccgcacacgaagcgcctgtaatgtagatccgcaattcttcctccttgagtcttggccggtttcgggggcagcaatatatcaagatctccttgcgtgtcagtgccgctattcaggactcacggtttatcactgccgattccgcatccgtatagttcttgcgccatcaggcgattggccataaaccctcctgttgaggtcaatgaagccggtgagtcaccggcacaaggaggaatcatggacgccagcgcaattcccgaaggtttcgccccgtttacccgcagcagtccgctgcttgatctgcttggtccgatctacgcgaagggcagtgggctgcaattggaactggggttgttgactgactcacgccatgccaatggccggggcaccttgcatggcggcgtattggcgacgttggccgatgtcggtatgggttacgccatggccttctccagcgacccgccacagccattgatcaccgcgagcatgaccctggattatctcggcgcggtaaaaatgaacgagtggctgcaagtgcgtctggaatactcgaaaaaaggacgccaactggcgttcgccgccgtcagcttgcatgtcggggagcgaacggtggcgcgggccagtgcggtgtttgcggtgccgatgggttgaaaaggcatggccatcaaggcgttggtccacagaccacagcatgatgctgatcgaatgagtgtggtccagtggaatgacggcatgtagtcggtagtggcttgccaaccactgctttcggccaatagcagacattcgattgagtgcctcctcgaaccaacctgccgatcttcacctagcgattgcggcgtttctagctacgcttgccagcaagagactggcgtaagtacgccagctcttgaattgcggactcgggagccaacatacatggatagcatgcaggacgtttacccatcagcgaccgttctggtggtcgacgatacacccgataacctgatgctgatcgcagagttgctcaaggacaaatatcgggtcaaggccgccaacagcggcgaaaaggccctgcgcctgctacaggcagacccgcttcccgacctgatcctgctggacatcatgatgccgggcctgtccggttatgacgttgccgagcagctcaagcttgacgctcgcattcgccacataccgatcattttcctgaccgccatgaccgctacgcaggacgagattcgcggcttgagcctcggtgctgcggattacatcaccaagccgatcattcccccggttctgatggcccgggtcgagactcagatcaagctcaaggccgttgccgatttcctgcgcaatcagaacgattttctggagcaggaagtgcaacggcgcacccgcgaggtgatcgccatccaggatgtcacgatccacgccatggcctcgctggctgaaacccgtgataacgaaaccggcaaccacattcgccgcacccagcactacatcaaacgcctggctgaactgttgcgcaatcacccgcgcttccgggacttcctcgacgaggacaccatcaaactgctcttcaaatcggcaccgctgcacgatatcggcaagattggcattcctgatcgcatcctgctgaaaccgggacggctgaccgccgaagagttcgagatcatgaaaacccacaccacattgggacgcgacgccatccagcacgccgaggatcagttgggaataaacgtcgacttccttcatctggccaaggaaattgcctacggccaccaggaaaaatgggatggcagtggctatccacaaggtgtggccaccgatgacatcccgatcagcgcccgattgatggccgtggcggatgtctacgatgcgctgatcagtcgccgcgtgtacaaacccggcatgccccacgagcaggcggtgaaaatcatccgcgaaggccgcggctcgcattttgatccggacatctgtgacgcgtttctcgccaatgccgaacagtttcgcgcaattgccgagcgatttgccgacagcgaccaggacatggccaggcagttagccctgcttgagcaaattgctgatcgtccctgagccccgcgcatcactctgcacatccagctgaaagaggccgtttatgaacagactgttcgagatgctcgagcgcctgtccctgcgcagcaaattgatcatcggcttcgcggcgttgatgacattgatcctgatactcggcgtgcaaagcctgcgcacccagtattcgcttaggcatgaaatgcagcagctgtaccaacaggatcttgccggtatccagcatgtgcaggaagttcgggtgcaactaccgcatctgttgctggccatgcaacgggcgatcgcgaccaataacgccgacatccgcatcagcgccagggcgcagatggaccgcgcccaagagcgcctcctcgaagcgttggcgcaggtgcgtccaacactgcgcagacagagcagcatcagcagcctgctggaattcgaacgggtattacagcgtctgcaaaaagatggcgatgaagcgttggagttcgccggcaaggggtccttgggtcaggccttgatgttgctcaacagtaaggattttcttgcgttggaacagggcggcgacgggttgctcaaccagatcgagaaaaacaaggaagccgacatccacgatacggcgaagaacctcgctgagtacgcccagcgcagcagcatgatcacctatgtcttgctgttgggcggttcaacgctggctttgctgttgacctggctggtcagctattccattcgtgtgccgctcaaccgtgtccgcgtggcggttgatgaattggcgtcgggcaagctggacggccagatcccccacaccgacctgcgcaacgaaaccggcgacctggcgcgggccattgccacgctgcaagtggaggcttgtcaacttgaacgccagcgttgggtgaaaggccatgcctcgctcctgcaagtggatctgcaacaggcagagacgccacagcagttggcccaggctttttttagccgcatcgcgccccgtttgggcatgtgccaaggggcgctttacgtgctttatgagggcgcgtcgcgcctgcaattagtcggcggttatgcggtggacagtgagcacccgttgcccgccgagcttgaactcggtgaggggttgcttggccagtgcgcactggatcgccaaccccgtcagcttgaggatctgcccgaatcgttctggcatgtgcgcgcgcagttgggcgcagcagccgccagccatctgatggtgcagccggtgctgcgtggcgagcgtctgctcggggttgtggaaatggctggctttcactcgctggaggagaaagaggcgttgctcttgcaagaagtcctgcccaggctggccggtgcgatggccattatggaacgcagcgaggcagcccaggcgctgctgcaggaaacacggcgccaggctgacgaaatgggcgcgcaaaccttgctgctggaacaccaggccagagagctggaggcccagcaggcagaactgcgcgccaccgaggcctggtaccgcggcatcatcgaggcagcaccggacggcatgctggtgctgggagccgacggccgcatcctgatgaccaacccgcaaatggacaccttgtttggttacgcccccggcgagctgattggcgccagcatcgagcgtctggtaccgcaggctgcccgcgagcggcatgtcaggttacgcgacggcttcattgccagtggcggaacccggcagatgggcggcgatctggacgatttgagcggagtacgcaaagacggcagcctgttctccgtggaaatcggcctttcccatttgccccgcctcgagggtcgtggcgtctgtgtgtgcgcctcggtgcgcgatgtcagtgagcgccgggcgatggaagccaggctgcgaattgccagcgatcgcctgaacctggcacaagaggccggtgacatcgggttattcgacgtcgatctggtcaccggcacaaactattggactcctcagcttgaaacgctgttcggacttgaggctggcggcttcggtggctcgttggcgcactggaaggcgctggtgcatcccgaggatgtggcgcgagtcagcagcacgttcgagaacgccgttcagagtggcgatgatcgcgtcgagttcgacttccggatcgtgcgtaaaaacgatgggcaggtgcgcacgttccgctcgctgaatcgcttctcacgcacacctgacggcaagccattgcgcgcaaccggcatcaacatcgacgtcaccgcactggcagaggctagggctgcagcggaagaggccacgctggccaagagcgagttcctcgccaacatgagccatgagatccgaacaccgatgaacgccatcatcggcatgagccacttggcgctgcgtacagaactggataaacgccagcgcaactacattgaaaaggtgcaccgatcagcggagaacctgctgggaatcatcaacgacatcctcgacttctctaagatcgaggccggcaggatgagcctcgaacacgtgcctttccgcctggaggacgtattcgacagcttcacctcgatgattggcctgaagaccgaggacaagggcctggagttgttgttccagatcccgcccgacttgcccacggcactgctgggcgatcctctgcggttggggcaagtgctgatcaacctgggcaacaacgcagccaaattcaccgagcacggcgagatcgtggtcggagtggaagaagtgggggcgcacacggacagtgtacaactgcatttctgggtccgcgacacaggcattggcatgaccgtcgagcagtgttcacgcctgtttcagtcattcagccaggcggacagttcgatcacccgcaaatacggtggcaccgggttggggctgtctatctcgaagaaactggtggagctgatggccggccgaatctgggtcgaaagtgaaccggggatcggctctacattccatttccaggtgcaactcggcgtgcagcaaaacgtgcagccgcgccgtatgttcaaggccggcgaactgcttggtatgcgggtactggtcgtggatgacaacaccagtgcccgtgaaattctctcgggcatggcacgcagctttggcctggaagtggatgtcgcgcagagcggtagtctggcgctgcgcatgctggccgacgccgagcacaaggtattgccttacgatctggtcttgatggactggcggatgcccggcatggatggcatggaggccgtgagcagaatgcattccgccagtctgatgcgcacaccatcggtcatcatggtgaccgcttttggccgcgaagaagcccgcgaagaagccgaacgccagggcctccagttgccggtgatactgaccaaacccgttacgccgtcctcgttactcgaagccatcggtgtcgtgctgggcagagacacgaacagcgatactcgggctggcgaacgctccctacagaatgccgataccgtcgccagtctcaagggagcgcggctgcttctggtcgaagataacgaactgaatcaggaattggccagcgagctgctggaaagtgtcggaatacgcttgcgactcgccacgcacggccaagaggccttggatatcctcggcgaggatggcgacttcgatggcgtgctgatggattgccagatgccagtgatggatggctacacggccacccggcaaattcgccagcaaccacgcttcagcactctgccagtgatcgccatgaccgccaacgctatggacggtgaccgcgagcgtgcgctcgaatgcggcatgaacgaccatatctccaagccactgaatgtcgaaacaatgttcgccaccatggcaaagtggatcaagccacgagccgctcaagcaccgctgaacgcagtcttcgccgatggcttgccagatcgtcttgagggcattgatctggcggcgggtctcgccacctgcatggggcggcgggatctctacttacgtctgctctgcaagtttcgcgatactcagacagactttgccgggcaattccaggccgcacgaatcgatccggatcctggtgccgcgggacggctggcgcacagtttgcgcggcaccgccggcaacatcggcgccaaggctgtggcgcaggcttgcacgttgttagaacaggcctgccagaacggcgagccggctatggtagtgcaagcgctagcgatgcaggtcgaacattgcttgctcccgaccctggcggctctggccaaccttaaaacaaacacaccggcctccatggatggctacccgctggacgactcggcaatcagcgagcaactgaacaggcttattgttcttttggacgaaggtgatacggcggcttcggacgtgctggtggcactgcgcaatatgccactcgatcgagcgttggcagaacggctggcactcgccgcggcgcaggtggaactgttcgactttgatcgcgccttgcagctcattcaggataaatgagttgggtagcaggtagccgctaaccattaactgcgattatcgagtcgacccagtccaggccaatacctggaaccccaaggatcccgggtacatgccgatcagctaagctgtctgctcagacgacttgagcagtgcacgatgcagcgaacaaatccgctttcatgttgggagtcgacgggcaaaggaaatgtttaatttctttttgacttttttgttcgtgttgatccccacggcgtcactttcactcgacagttatctgcgttaccgagtggcaaaaaaccgcccggtgagcaaggcgtggaaaggttgcaatcacgtgcttgcgatcctgctgatcatgcagttgctgggtttggcgctgtacttcttttacctcgcctgagcctgaacgtttacgccagttcgtcaggcaccttaacggcctcgatgcgcgccgaaatccattgccgactgtaggccagaacgccctgagcgagggccgtggggaagtggataaagccgtggggcgaggagggcagcaggtacatgtcgaccggcgccgattgcgcccagcgtctggcgatgtcgagggtgtcgtcgcgcagtggatcgagctcaccggcaaacagcagggcgggcgggaaaccgctgaagtcgccgtacaggggtgataacggtggctggcgacgctgttcgtcagtcagctgcggggtgagcaagcgcagtgcctcgaccatgccggggccgtccagcaccagtgtgtcggcaggcgcgctgcgtacgcttggggttccggtcaggtcgtagacgccgtaatacagcagcgcggcgctgatgcgttgcagcaactccggccactgcttgagcgccagcaaggtcgccgcggccagatgaccgcccgccgactcaccgatcaccaccacgggcagaccggcaaattcggcatcactcaataccccgcgagtggcgctgaggcagtcttccagcagaccttcaatcggtgtcgacaccgctaagcgataatcgaccgagaccaccgtcacctggcaggtgttgacgatggcgatgttgaaattgtcgtccatctgcgcattgccgatcacccagccgccaccgtggaagtccagcaccacgccttttgccggacctttggggcggatgatccgcaccggtacattccccagcatcttctgctcagccgtcagaccatgctcgcgcaacttccttgcaccgccgacctgactgacgcgcaacagtgcctgaatcaagcgcggcgtcaggcgattgcggatcttgaaacgcggcagccaggcgagtttgcggttgaaggcgcgcacctgcgccaactcgcgctggccttgcggccacggtgtttcggtcccccaattggcattggtcatcagcggttcttgatcaggatggagaaattcaacgcggcggccacacacagccacgccagatacggaaacaggatcaagccagtgatcaggtccagttgtatcgccagcaccaccattgccgcaaccaccagccacagcaccgtgagaatcaccatcgccgccagcacctgatgcgcgccgaagaacaccggcgtccacagcgtgttcaacgcaatctgcgccgcccatagggctagcacggtctggctgccggggatcaggctcaagcggtaaccggcccaggccaacagcagatagataatcgtccaggccacagggaacgcccagttgggcggggtaaaaccgggtttgttcagtgtttcgtaccacggccccggtttgaacatcacgccggtggctgccgctgctgcgcaggccagaagaaaaataaaaaaggtcatcgccgatccttggctgcaagcagccggtaaggggtttaagaaaaggacgccccggcgcgcgaaaagtttgctatgaaatccagattgaccggagaggctattcaatttgaactaaaaactgaccaccgcgtcaggataatcagttgcctttttctactgacgcggatgacatcatgtacacctatcacatcgattaccgattcaacggcgagcctcgcacctttctgcttgaactcaaagaacagcagctagccgagcacgaggccgcgatgcatctgctcgagttgcacctgggcgacgcggaaaatggcctgatcatgcccactgcggattcgacggccgaggagattctcgaacatgcagagcgggtagggattacgcaaataacggttgtcggcaaaaccaactgaagcgcgaagcagacgttggctcatgcgcaaggttcttcgagcttagaccggtatcgctgcttccagcgctccatgctctacgtgcgcgctctctctatagaaccgccaaaactcatccgccggcatagccttaccaaacagccagccctgaccaaactgcacaccgtgaccgcgcaggtaatcgcgctgcgcttcggtctcaatgccttcggcaacgatctgcagacgcagactcttggccatttcgatgatgtggccggtcactgatccggtggccgcgtcttgctcgatgttatcgacgaacgacttgtcgatcttcagcacatccagcggcaattgctgcaaatgctgaagactggaaaaaccggtgccgaaatcgtcgatggccgccagatagcccagctcgcgggcgcgattgactgtcgtgcgcgcggcgtcgatctcgacgaaaccgcgttcggtggcttccagccagatctgctgttgctgcacatcggcgcggcgtaatgctgcctccagcttcggcagaaagcggccgctgctgacgtctttggccgccaggttgattgccacgtgcaagccgcgctccttgaccagcaacgggccgaggtcgcgcatcacattgtcgatgacctgatcggtgatcggcagaatcaaaccgctgtgctcggccagggggataaacgcatcggggcagacccgcgtaccgtccgggtgctgccaacgcaccagtgcctcagcgccaacgcaggcgccgtcgtccaagcgaataatcggttgatagtgaacgacgaactcacggttgcgcaccgccaattgcaattcggccagcggcgacaggcgttggcgagtgcggcgcacgatccgcaacaccagcacgccggcgagtaaaccgccgatgggcagcatcagcatttcccggcgaaccaagccctgtatcagctcatggcgtgacagcgcggcgatcgccacccagtcgccgctgtgcacgagggtgtagaggtagccgtcgtcgagccccgagtgcggaccagaatgcacccgagcgagaaagtgttccgcgccggggcgcgaggcgctgaccagttgcccggcagcggtgccgacggccagatgcagatcctcatcgagcgttacatgcaggaactgctgtggatcgaccagcacattgaacgcggcgtattgcagagccatcatcggcttggccgcgacgatgcgcgactgcacaccgagggacacgcgcacaccgtcggcggtgatgaagtcttcctgccacggcgccgcatgctggccgaccgtaccccacgaaccgcaggcgtaaatctcttcttcgacgtaaccgatcgacttcactgacagggtgttgatggtcagcagccgcatctcgtcgatgctctccggcgtgcagggggcgaggttcgaaccggcgatgctcttcagcgcaccggctgcttcgctgaaggtgccattggcgcggctggaggccaccgccgcgagggtttccaggcgctgctgcgccgccgccagattcaacatccaggcgacgtaacccatcaaaaggagcggaagcaagacacacggaaggcccaggagaacgctcccccagacaatgcgttttttgttcatttggcgccaccttggccacaaggcctgtgacgtgcgcacagcacggctgttttcagccactgcacaataacgccgccgggatcggcggatattgttgtagatcaactattccactgccggccttcaatccctgtggtttgccacaggtttgtggcaaaccacagatctccaatagaccaaagaaccctgtaggagtgagcctgctcgcgatcgcggtctatcagccacatcattgctaaatgacccaccgctatcgcgagcaggctcactcctacaaaatttgtgtcaaatccaggatatccagcaatcccgaactcctgcagtttttgtgtgaaagccgagatatccagcatcccgaagaaccctgtgggagcgagcttgctcgcgaaggggccctgtcagccaacctcacattaactgacctgccgcattcgcgagcaagctcgctcccacagtgtcgccgctcaaactccaccatccgacccgatggacaattcacgcaccccacggcccattcgcgcaggcatttccgtgcagcgcgaatttgtcatattcggtctaaatccggtgcagatagtaggcagcccaacgctaaccgaaatgaggctgcaccgtgttccaacgtctgctgtgttcgctgtccgtactgagcctgtccatcaccgccgcccatgctgccgaaacagtgccgctggacaccccgcgcctgaaaggcatggacaatttccgcgatgtcgccggcaccaccaccgcgtattccaccgctcacgacggcaccatgcgcgctggcgtgttctaccgcgccaacgcggtaactccaactgcctctgacttggcgaccctcaacagcctcggcatcaaagccgtttacgacctgcgtactcccagcgaaatcgccgccacgccggacacaatgatcagcggcgcgacctggcagaacatcgacatcatcggcagcaccacctccggcgcgaacatcaccaccgtctcgttcaaaagcgccgccgacgccatcgccatgatggagcagaccaaccgtgccttcgtcagcgacgccggcatgcgcggccagttcggcaagctgttcaatgaactcgccagcgtcgatgccgcgcaactgttccactgcaccgccggcaaggaccgcaccggctggaccgccgccgtgttgcaaagcatcgccggtgtcgacaacgcgaccatcatggccaactacctcgccaccaacgactacaccgccgcccgcgtcgccgccacgttgaaagcgatgcccgccagtatggccgccgtgtatgagccactgctcggcgttcaggccagctacctgcaggccggcctcgacgaagtcaccgcgcaatacggcagcatggacaactacctcaaacagggcctcggcctgtcgcaggaaaccatctacgtcctgcgcggcaaactggtcgaatacaacagcctgccgggccaggccgggctgatcggcaacgccgccgccggtgccgaattgctccgccaattgcagaacaccaacctgtccggcacctacagcgcctacaactactacctgcaatcggccattgatgccggcactctcggcggtgtcgaatcccaggtcggcggtcaggtccacgccgacgccgccagctacctgctgcggcaaaacgcgatgatcgaacaagccgccgcaccattcgccagcggcagcgacctcaaagtcggccaatatcgcctctggaccaccgcgctcgccggctacctcggcaccgacggttcggcccacgccgagagcagcaacgaacacagccaaggcctgatggtcggcatcacccaacgcttcagcgaacaactcagcgcacgcggcggattcggctacagcaaaggctcggtcggcggtgcagggggcgaagccgacaccgacttcaccttcctcaacgtcggcgcccgctacggtttcaccagtctcgaacaaggcctgttcctcgacgccaacgccagcgccggctacatcgactacgacagcaaacgcgacctcggcggcggcctcggcaccgcgaagggcgatacccacggcaacctcaccggtgccaccgtcgccctcggctaccgcgccccaatcaacggcatgaccttcgaaccaagcctgggtttgcgcatcagccacttagacctcaacggcttcacagagaagggcagcgaactctccctcgacgtcgacgacaacagcgccacccgccgcagcgccgtcgccaacctcaacgtcgccttcgcccccgtggccatgggcgcatggcaactggtgcccggcgtacaagtcggttacgaacgcacactgggcgacaaccaggtcgacagccaaagccacctgctcggcctcgacatcgaacaacgcgccgccttcgacaaccgcgaccaattcagcggcggcgtcaaccttatggccaacctcggcgccctgagcttcggcgcagaagtgggcgcgaatggcggcggtgacagccatggcttcaacggcggcctcaaggccagctacgccttctaaaacaaacacgggatcaaggatgccccccaatccaaccaacaccccaaaacccaatgtgggagcgagcctgctcgcgaaagcgccagaccagtcaacatcaaatcgactgacccaccgccttcgcgagcaagcccgctcccacaaaagcccctcaccctaaccctctcccgaagggagaggggactgaccgcgtggattggaagagttacaccgacctggcataccgagtcgagctcaaattttgaaaagccctccaatcggctccctctccctcgggagagggctgggcgggcggcgttccgatgaggggcagccccaccacaaaacctgcgagtgtcccttgcgcttgtatatgaagttgtgggagaggggactgaccgaggcgtcttgcgtcatgcatcgacctgaaagatcgaggcgattatggattcaaagcaagactctcaggtcgatgtagatcttcaatatccccggctcggttccctctccttggggagagggataggcgggcggcgttccgatgaggggaaagcagttaccgcaaaatcaactggccaactcggtcaaacgcctccgcgcccactcctcgatcaaccgcgccggcgtgccatccccacgcttagcgacccatcggcgcggtgcgacgtttagctaaatattctcaccacaagttaccttgcaaacctgttacccaatcacccccgagcccgaaactccgccggactcaccccaaaagcaccctgaaaataacgacaaaaccgccccacattactaaacccaaaccgcaacgccacctccgtcaccgaccccgaaccccgccgcttcaacacctcataagcccgctccagccgcacctgccgctgatacgccacaatcgacatcccgacaaaccgccgaaacccctcctgcaacgcgcgctgactcacattgcacaaccgcgccagatccacaccactcaccaactgctccggatgcgcctgaataaactccaccgccaacttcacatgcctcggcgcaaccattgccgtcggccgtcgcaacgcctcggaaaagttatgcggccaagcctccagcaccgcatcgatcaacatctcgcgcaaccgcgacggcatcagcgtcccgctgttgagcaacagatcaaactccgcccccgtcgccagatcaatcaacgcccgaatcccctgaaacgctgcagtgttcaggtccacgctgggtgcaaaaacgatcttctgcagaatcggtttatccaacagcatcgacaaccgctcggtaagctgatgacgattgatcgacatgccgtgatgcgcatgatcatcaacaaagcgcatcgaacgaatatcggccttatcaatcgccagacccacctgcgtcacaccgatggactcggtcgcgtggttgaaaacaatcttgcccgccgtggggatcacaaacgtgatctcatcctgcggatcgggaaacgaaacgctgaaatcgccgtggtaatgcatgcgccggaaactcacgccatcgtgccgcccataaacgccgccgataatgatgttcgacggcagcggcggggagtcggaataacggttaccgaagaatcgggagaacaacgcgccgaagtcatcggaacgaagattgtcggagcgcaggatgatttgctggcgaacaggagtcggaaacaccttggcggcaccttcggttgggggctctaggactggggtgtagggcagggcgccgagcagattagcagaggcaatatgacgcgtttgtgacagtcagaaacatgtcgttacagcgccgcaacacgtttgagcaacggacactcggcaggccatgcccgacatggcaacctgctcgcatccgtactcagcaaaaaaacaaaggcatcgcgccgagcgcccagccttgtttaccgagacctgaaagcattcaagtaaattggagcggcaatgcaagccaacacgcaaacactccccatcaccctgaccccggaactcgacttcgaccaaaacgccgccagcgctttcggcgaatcgctgacccacgaatacacccaggccacgccattcccgcacatcgtcatcgacaacttcctgcaagccgacgtcatcgccagcatccgcgaacacttcccggtcgaaccgaccaacaacgaacaaatctacgaacgcggctacaaaggccaactcaaacgccagatcagccccaacgcctgcagcccctacctgaagaacgtcttcaacaccttcaactccgcgccaatgctggagttccttgaaaaactcaccggcattcaagggctgatccccgatccttatttcgccggcggtggattacacgaaaccaaaaccggcggcttcctcggcgtgcactcggattttcgactaaacaaaaagctcaacgtagagcgacggctgaacgtgatcatttacctgaccgaggactggcaggaagcgtacggtggcaacctggagctttgggatgtggggatgaaaaagtgcctgaagaaggttctgccggtttataaccggtgtgtgatttttaatacggacaaggacagcaatcatgggcatccggagccgttgactacgccggaacacatcactcggcggtcgattgcgctttattactacacggcgagtggggtgggcggggagccgggacagaggaataaaacgcactataagccgcggccgaaggatcggtggagtttgaggtattactggaacaaggtgttcaagaaaaaaggttgaagtagcgctcgcgtatcgacggttcaggcggttttttgcaggaaaataaccttgtcttggtataaaagtgtttaagatcagtggcttccaactaggtattgctattaatttttccggtatgtaaattcaagctgcgtaagcgtatcgcttatgtgctgcagtcgattgtttttagatcctggattttgctcttaggagcgcttgaggtttacttcgagcttgtccggaggctcgcacctccgatctcctccgaagaacctggaggagacagggacggtaggtttggccatgtgaaggatggcagctgccagcgatctgatcgatgaatgcatcatccttcactgcacccttgcgtatgggttggtcaaatctatttttaaagggatttaaaaatggtccttcttaatcctaaaaaagtttccaacggttcgatttctagtatcgaaaacctgtgtagtgcgctatctgtttcccttcaggaaatttacagtgcgctatctcttcctgatgatgaaaaatatacggtatctcatatccctaaaagcgatggaggcgttagatttgtttataatcctcattatttacttcgaaggattcagcgtagagtaaataagaggatattttctaggctcagcataattcagtggcctgatcacttattcggttctgtgcccaatcaactagatcagaaaaatcaaagcattatcaataaagattatgtgtcgtgtgcagcaaagcattgcggtgccaaaagcctactgaaagtagatgtgaaagatttttttgataatattcaccaagatttggtgctcgatatatttgaaaatttcatgaagtttgatagggaggtttcggagttgctcgctgagatctgctgctttaattctcatgtgattcaaggagcattgacatcgagttatttagcaagcttgtgtctgtatgatgctgagggttcagttgttcaaaggctggcaaggaaggggctagtctatactcggttggtggacgatattacagtgtcttcaaaaatttctaactacgattttgactactctttagatattattaaagatatgctgaccagcaaggatcttccacttaatctcgccaaaactcgtactgtacatgtctcaagtgaaccacttaccgtgcatggtttaagagtcgccttttcgcaacctcgccttccttctggagaagtctcgagaattagagctgcggtaaagaatatagaaaatttagcgtctgaacgaggctacagaacaactcacgcttatcgccatgactttaatcgatgtatggggagggttaataagttggttagagttggtcacgatagatataattcattgctagctcgactaaaaaaaatattccctttgccttcaaaaaaagatattgaccgggcaaatgcaatgttggatcgccttatacgtgactttgatactaggcgaagcacgtactggtatgctaagcgatattacaaactgcaggaaaggctaattgttctcaagcgctcgtttccatcaatcactaaagagatcagaaagtctttgaaaggattacggcctgattatgactagaatgttcaaaggaggttgggcgcgctacccatatttgaattatttagtcgtcagcctttttttagtggctgcgattgggttcatgtttagtgtctttgtattaatggttacgggtctctctggcgagtttgctcgcccactatgctttaataatgggtgcgttaaaaagtttttagaggtttttgatcaatctttcctgattttgtcagcgacgctgagtttgcttgtggggggcacaacaataggtggcataattgttgctctcatgagctatctaaatagcgccaatgcgacagcgctgacaaatcatatttctcatttttctatattccaaaattttgtcgcggcagaaatctctaagcgcaatcgtatatcccaaacgtccgtcgatgcttttgtttggtataatctgattttctctgagtcccgaactgggagaatgtctatttcagatgattattgtagtcttatttccgctttaaatgctgaaatatttctttcaaatgagcaggctagaacagcggctcaaggctcttttcgctatatgtctcatcaaaaaagaattattgattcgttaggctctttaggtgttttgctaaatcatcagcccagaaatgaattctacgaaattgaagatcaagtttttgcgttaatatccagcttaaataaatccttttgttattctgataaagttccgaagttgttggggcgcaattatgtttgagtcttttttttttttttttttttttttttttttttttttttttttttttttttttttttggcgtacttttaggtttttggttttgtcaggctctcaatgatatgttttgccaattgtctttttgattcattagatgtgggtggtatgatcgccgtttcaacattgggtttcctaaaattggcgacgagatgcgcagtgttcagatgctcaatgccaaaaatattcagaattaaaggggtgggttactgtattgacaagacaatacatccacccctctaccacattatttgtttttcttatctggtgcttgtgtcagcgctgagcctgcaacagatttttgatccggtgtggattttttgtctttcagttgctcgcttgccttcgacgccacgcctttgctagttttctcgtcttttgccattttctttccctcaaaaatgggtggattctcgagattaagaaccctcccccgggaataggtataggccatgtgccattattttcaatctcctagaccattttttgagaaacgcggttatctgcggtttagctgagcaagctttttcaaaggggaccgatttattttctcagaataaatttagtcctatttcctcaagaaagccgcacgctcagtcattatggccgttgggggcggcagttgtttcctggatgaagggggaggaattttcgcattggaacatcttctgacagaaccacaacggaccgaaatcagagcggcactctccgatccattcaacgactttccgatcgaatatgactacttggcgaggaaagtcagaggcgtcgatcctgatgtcctttatgaaatcctctattcagaggtcgcgccggtgtgtttcaccaatcttgtggcggctgtacctccggtatggacaggcttcgaccccgaatctctcagggaatcgatagaggaaaggttggctgcgagagagcgtagttggtttcgtcggcagttcgataaggtgctggtgcgttggctgaaatacaactacgcctacatctggaaggaaatcgttagcaggctgtagcttggaagttttagaaaaaaaggaaaaatgggacagatttattttctgtctagaggggcgtgtctggtcgacctccatgacgacaccctagccgtcatggagggattttcgttactccaccggcacaacgttatccaatgcctgattcaccgccagttcccccaacatcaccacctgcgcgatgccttgcaacgtcttgcgtgcaggtccccgcaccaatccgatcacatcccccagcatcaccgaagccgagcccaacgactcactggcattgaccagtaattcttcagttttggttttcgggttagcggtgaacatggtgctgggttgatacggcgtggccatgatatcggggttgggggttgggccgaggtaatgggagagggcgcggtcgacggcttcgttgaatttctttgcgtctggggattcgtcgcctgagattggatcggtttctggcggattcggtgtgatcttgaacatgatgtaactcccttgtgtcgcttaagaggagccatcacccactcgctaccaaacgatgggtggcggccatgcacaggttggtagaccgggacacaaggaaaaccggcgcgctcgaaagcgccctgcgcatgaccaccataaaagccaggcgaagaccttcgccaatagtgaaattgcgcaccttgtatacacgggctaccaaacccgatcactgctattcagtgaccgacccacgatagaacccgcccacccggcgcacaagccggcggattctggcgtagtcgtaggcaacggcgcaaggcgttgtagcctgttggacgtatttcggaacgcttttaaacgggtcgtttgaaatgccagaagtccgaggcctgacacccgtaaaaacgcttcaactcctccacaaaatcaacgcattcccaccaacgttgccatagtcttcattgcatacggcgcgctctgaaacgccagcacgtattcatacttcatcatttttccgagccccaacgccctcagttcattcgacaagatgccatcgcccaatgtgagcgtcagctcttctgcatttctgctgaaggcgtggtggatttgccggaacaccgcgtattcataagcgtatttatgattttgacaggcacgtgatcaggcagtttttcaagcgcaagctaatatcaaagtgcaattattgagagcgccccgaccgccgctagtggatcccactgagatagcgaggccgggctaattccgatgtgcatcatggaggacagcgcatgagcctgttactcggtcccatcctgcatgctgccgacctgattcagccagttaccgcaaacaagtagcgcaggtttccaccatcgaggttctctgaatggtcaccctattgacgagtcttcgcttcgcctgccaagtcgtgctgatggtgctggtgccaatcacattggtcctggcaactgatgtaacgcctgaggaaaagacattcctgcccgtagcgctaaaggactggattgtcatcggcagtaccgtcgtgagcatattcattgccttctggggtgtgaagaacggtcttcaatccgccagaaaagccattgacgaaaaacagaacgagcaccgtcaaaagcaactggctgcggcgcgcgacatgataaaggagatattcagcgacccgctggcgcgctcggcaatgcggatgatggactggtcgggccgaaactttacctacgagaaccagtgtttgacggtgcattggagagatttgaaaccggcgcttgttgtgcaccagcagggtatgggatttgacaaacagcaggagttcatccgcgactgtttcgagtccttctttgaccacatgctcgtgcttgaacacttcatcgagcaacgctacttaaacgaggccgatatagcagtccctctagagtattacgcgggacaggtcatgaatttccctcaaacctacgatggattcctgctcgcgtatggctatggtgaagcccgtgacctgttgcagcgtctggcactgcgccgtaagtaacacatgcttgttcaatgaccggaagaaaccgctcgatcggcgctcgagcgcaatgtccgcagacatcaacagaaggatagaggaatcaatcatgggcatcgtccgcgtggcagcagccatgctggttctattgtttatttcgggctgcacttttcatcaacaatggagagacgaaacccaggtctgtgtaatagatcaatcggaggaagggagcgaccagtgcgaacgggcgcaactgcagaagcgacaaggtcccggggaatatacgatcggatacgtcgagttcaacgatcaaggagaactgttcagcaggcagcagatgaatgacgtgctgggcgccttgcaagagaaggccggtaggggagacgtgctcatggttgtcttcgcacatggatggaatcaccgggcaaaagaaggggatgggaacatcaatacattcaggaaagtattggaaaacgtatcgctcaccgaggccaaagatgccaatgaaaaacagaggccgcgcagggaggtgtttggcatttaccttggctggagaggactgtctctaagggttccggtgctggagtttctgacattttgggaccgcaagaatacttccgccaaagtgggagcaggggatgtgaccgaactgctcagccgtatcgaattggtgaagcgtacgcgtgatgcgatcaaagctcaggaagtaacggagtcagtcatcgcctcgtgcaaagaccacccatgtattgacgagcttgataaggcaaaagcagccaaaagtgatactcgactagtagtcattggccacagcttcggtggtttggtggtgcagtcggcaatagaccgagtccttattgatagagcgatcaggacgggcggagccggcgcgggctatcagggcactatcgaaggtttcggaaatctggtgattctgatcaacccggcatttgaggctcaacggttcaattccatgttcaagctgcaagacgagcgcaagacttactttgacgaccagctgcccgtcgagttggttcttacttcgcgtcgtgactacgcaacgaaattcgcgtttccagtaggcagggcattttccagtgcctttgagaagaagggctgggcttcgaagaatctgcaaaccatcgggcattacgagtccttcgtaacacatactctaaatacgcctacaccggagttgctgaagtctcctcaatatgcggattgctttaatgaccctgcaacaatcgctcattcctggtattcgggagatcgcaaaggtaacagacatatttttggtggacttattctggaaagggataagttgtccgagcggtcaccctttctcaacgtcagcgtgtcaggagatctgattacaggtcataacgacgtggacgaagatttgattatcaagttcgcttcaagaatgatcagtttgtcctcaatcaccgagcgtcagaagaaatcagctgcggaaaaagtagtcaatctgaagtcttgcgatctggcgttgcagtgaaaccagacggtcagcatgcttgtgataagtgctgctcctgaagacatggaaaaaacgtatgaaaaggggcgttcgctgaacgcccctttattcgcgcgatttctctatgggcaacctcctggaatcagcccaaacgcctacataacaatacctacacccaatcctccgaaaggaaccccaagccatgagcactcaaaccgaaaccgccatcctcgccggcggctgcttctgggacatgtataaaaagaacggggacagattcatttttcaagaatgatgctgtcgccaatttcgtttgcatggcggcatcgtcaggtcgtaagcgaaatcagcgtatcgatcacattaatcggcacataaatcagcgtaatcaccgcatacgctttacgcgaccgagccaaaaacgcgccaatcggcaacacaatcatgatcacgtccagcaaaccccaaagcgccaccggcgaggcctgaaacaacgtgatattgacgatcagccccaggcccagatacgtggacagcgacagcaatgcgtatcgcccatcctgttcgaaatacacgcgcaaaccattctgctcatcctcactgcggctcggcagcaacaacgccgccgtgacgaacagcgagagtgtcagtatcaccagcagtagaaattcgagaaacgagaagctctgtttcaccaccgacagtgcgttgacggcccaccagaattgcagctgcatggtaaacagcatcaccgcccagaccagcgccacccaatctggcttggctactcggcggatgcggaacaccgttaatacgccgagcagcaggcgggtgacggagagtccgaggatcatcgagagaacggtggcgacgattgggaagttgctcatcttgcctctcgtgaactcggttttggctgaaagggtgatttgggcagactaggtggggcgggtaggaccgtcaaacgcggctgtgccgttggttggcagaaatcggcagcggattcttgttgtgctgaggcaatggattaggatgcgcgaaggctggaatggatcttctcgactaaggatgtgcggtttatggaatctgatttttcgccaatcaccgagcgtttgaacaaccgccgcttctctgtagcgaacaatgctcaggggctgtccgatgcgcgcacggtgtttcactacttcgtcgaaggcgcggcggtttgggggacttatgcgggtggacatattcgccagggcaaccaggtcgggcgggtgaccgggccggacactatcgagctgctttatcagtgcatcaccacggatggcgagattcgtgcaggttggtcgcggggagtggtgggggttgatgaggcggggcggacgacgttgcggtttgtgtggggttggttgtcgggggccgagggtggcggggagtcgagttatgttgaggtggttgcgtagcgatggggcatcttgtgattatcgcgtgctgctcggcactaatctttcaacgcaaggatggctatgtctgtagatcttgatgagtggctggaacgtgtcaccgatgagcaatcgttcatcgatttcgtcgcggcgctgggtgctgatttttcccgtgagcgggcgctggagaattccagtgaggcgggggcgtcggactgggaaaatggatcggtcgatacgtttcttgatgcggcggctgcttgggcggtggctacttcgaggaatgctcaggcggatgccgcagcttctaatgtctggcagcggtgtgcggcgattttgttggctgggaagttttatgagtgaggcgggaagcagttcatccgctttaggcctgcacatttttttaataagaaaacgcccaagggtttggcgtgtcctggatggttaggaccgcgtactgccttgggcgagatgggtgcagattaggtgggggcaatgtagacgtcaactcttcgccatcacatcccacgtccgcatcacctgcgtaatcgccgcatcaatactctcaatcggcgtgccatcccgagcaaggatggaaatcccctgcaggaaactgtcgaataccgtcgccatggcggctgcgttcgtgtcgtcggctaacagcccttcactcacaccacgctcgacacacgccacaattccggcgcgggttcgggcgcgggagtgggtgagggcttgggcgacgtgggcgttttccgggctcggggcgctcatgacgccgagggtgaccatgcagcctttggggtggccgtcgtcgcattgcatgcgtgccgattggcgcagggcggtttcgagggcttggcgtggcggcagggtttcgtcccacaggcattcggtgacttgggcgtaggttgccaggtaacgctgcacgcattcgtcgaacagtgcttctttggagccgaacgcggcgtagaagcttggcgcggaaatgccgccgcccagttcagccttcaactgtgcgagggacgtcgcgtcgtagccgtgttgccagaacaattgcatggcctgatcgacggcgtcgtcgcgatcgaatgcgcgggggcggccggttctggccatagctgaaactcctcggaaagtgatttggatactagtcgatacataagtcgttgacaacgggcctcggctgccgccagtattttatatcgatcggtacgcaagtctgaatttccaaactcaaggagtttcccgtgacaccttcattgactctctcggcggcgcccaaacgcctgcccattggcgcgctgttggcgctggccatgaccggttttatttgtatcgtcaccgaaaccctgcccgccgggctgttgccgctgatcagcgaaggcttggcgatttcgccttcgatggccgggcagatggtcaccgcgtatgcgctgggctcggtgctggcggtgatcccgatgaccatcgccacgcgcggctggcggcggcgcaatgtgttgttgctgaccatcgttgggtttctgttgttcaactcgatcacggcgctgtcgtcgcactatggcgtgacgctggtggcgcgcttcttcgcgggtgtcgcggcagggttggcgtggagtttgttggccggttatgcgcggcggatggtcgagccggatcagcagggcaaggcgttggcgctggcgatggtgggcacgccgattgccctgtcattgggcgtgccgctcggcacttggctgggcgggttggtcgggtggcgcacgacgttcgggttgatgtcggccctgaccttgatgctgattgtttgggtgttggtgaaggtgccggattatccgccgcagcctgcgcatcagcgtctgtcgctgcgccgcgtgttgaccacgccgggtgtgcggccagtgctggcggtggtgatcagctggatgctggcgcacaacattctttacacctacatcgccccgtttgtggcgccggcggggttggcggatcgtgtggatctggtgttgttggtgtttggtcttgcggcgttggcggggatttggttgacggccaaactggttgagccgctgttgcgcaagaccgtgttagccagcctggtgatgtttgccgtggtgtgtgtggggtttggattttgggggcgtgtgcctgaggtgatttacctcggcgtgttgctgtggggattgagttttggtggcgccgcgactttgttgcagaccgcgttggcagatgcggcgggcgatggcgcggatgtggcgttgtcgttgaatgtggtggcatggaatagcgcgattgccggcagcggcgtggtcggcggggtgttgctggatcggtggggggttgcatcgtttccgtgggcgatggtggtgttggtcgcggtcgggtttgtgattgcctggagcgctcgggcgcacgggtttaaagcggggccgcgtggtgcgggggcgggggctgtggtcgggcactgaggttgggtgtcaggttgatgtgtttttgatgggctgacgtcatcgctaacagggctagctcccacagggatgtgggtgggattgggatttgtggtttgccgtgaaacccatgtaggagtgagcctgctcgcgatggcggcgactcagtcagcctgatgtcggctggacggatgctatcgcgagcaggctcactcctacaaagaacgtggtctagccctgcgcttcatccttcaaatcatccagcgtatcgactatcgcctcatcgcggtcggccatcgcgtcttgcatgtctttggcgatggtggtctggatggtcatgactttttgcgccagatcgcggccctgtttcgaattgaggatgattgccatggcctgctcggggtgctggttggcgcgaatcatcaggtcgagttcatcgttgtcgaagtgatcagcgtagatttccacgaccatgtccttcaggtcgtcgggatcgatgttttcccgcacgacgttacggatctgctcgcgctcgagcatcggatagcgggtggcgtaaccggtggacaccatttcgatcatgttgccgtattgcttggtcattccgctggactcgaccagtttctctgccttgtccttgctaccgccgcaacccgccagcgccacggccatcaatacggccagcgttacttttttcatgctcatgagcatcgttccttgaaagatttgaagtgcaggaggcttaacggcgacttagcgcgtaggcgccggcgatgattaccagcaccacaccgccgatgaatgcgccgagcgcagggaacatcgccgccggccacatcaggccccggccgaggttgtagaagaagcctgcgtgggagtagatggagctgaacagccaggagtagagcgcgtagatcaagccgatgagcagataaccggagattatctttcctttgagcgacatgaagtcttccttgtgcgggggtgaagcaggggatggattttgagtaacatactatttcagtagtggcacatcaatggcattgctgcctcatccgctgagtttcactcacacaagcgcttgataaaccggttgttcttgtctgcaaaagccttgctgtcagcgcttcgccagactgtcttgctgcttccaggcctgctgcaagaactcgttgatcaacgttgcaacctgctgctggataaccccccgaggacgcgcagcctcgccatcgccacaaatgattccatcgccaggcacgtcttcttcaagcagtgccacggcacccggtttgcacatggccaggaaagtgaaatggctggcatcgcggatctcgacatactgcgttgacgcctgcggcaggcgtttggcgaggtcggctgactccagttgcgcaggcagatcctgcgacggcgcacctgcagcgatcaccagcgccggcaccggcagtcccgccaggctttcactggtcatcccgcgcgaaaaaccgaggtcaagggaaaccacggcggtgacgcgtttgtcgcgcaagtcgctggccaactgagttttcagtgcgggcgtgctggccggattgatcttgtcgtaattgatgcaactggccagttgtgaatgaaccttgcagtcacgcgcaaacagctccggatcgaaccgcgccccggcgatttcaatggccgtccagccgccaagcgaatggcccaccacagcaatctggcgcggtgcgacggcgccaaacttctgcggctgcgaggtcaccgccgcaatcgcccggctcaggtcgaccggccgctgccacaactgctcggcagcttgcgggctacggtcatgggtggtggtgccggggtggttgaccgccgcgacgatgtaaccctgctgggccaacgcactcgccagccagccctgattgctccagttgccccgataaccatgggaaagcaccaccagtgggtgctcgcctgcgctggccggggcgtcgcgcacggcggcattgccgacaaacaccacatcgtcggcgatcaattgtggcgtggcggtggttgtgccgggataccagaccaccatctccagcgcacgctcattgtgcgggtcgggcagggtcgaggactggaaaccgatagcgttgacgtcagcgagagcgctggtggtcaggcaggttagaagcagggcaccgagagctggtttcaatgagtggatcttccatgattgggcgagggggatagcaatttgcaatccgctggcagtgtgcaacacagtttgcacactttaaagctccccgcgcgcgatattcaggcccggccgcaagtgcccctgaatatcactccacgcacagtttcggggtaataaggatttccccggaagcgtcggctttacttgtcccttcgacattgtgcgcaggatctttacgaccgctccactcgacgggatacggcccggtcggggccagtatcgtttgcattcgagtcatgaaatcagcgtcgcttcgggcgtagaaaacccactctcgacgttgctcaccggtcactgtgcatacccacttcgccaggccgttttccgttgcggccgactttagcaaagcttccatttcattcatgcgcaccagatcgcgaggtcgcggcaggaatttccgggaagtgtagttccagcggattttcatcttgaacggcaacgcttgctgctccgccgcagaaattttgttggcagtgtggtagctcatggggcctgggatatccgggtagtcggaatcctgtagagggaactcccccggatcggcgagacgtgcttgtgtataaagatcaggaccagtgccaagaatggccttgagtgccgcatctctttcgtcattacggtcaaccacacagtcctcgtaagcggcactctggcttgggccttcatccaggcacgggtcgcgatcgaccggtggcggtggatgggagcatccagcgttgagcagagctgatgatgccaacagcattagcagcggcaaagtgcgattaagggtgtttcggtcgttggatttaatgcgattcaaaaacgtgccttccttgggaggggcgggggatagtttggcggcgagaggcgtgccggaaatgcctgtttaatgccgcttatcaaatcagcgactttttgaaatcacgctgctcatgtattgattcaagtcgcgaaagtcttcaacgctccaggcgtgcggcgctatttttacgccgttctcgcgcagggttctcggaatcaagtcgccattggggcgaaggatgatcgaggagacgatgacccccggataatcattcaggcgtttcttgaaggcggttgttgtcaggtcaggtgtcggcggctggcttttatttgccaaggggcctgttgctttgatatctgctccgtggcacatcgcacatcgctgtagaaaaagattcttgccattggcgttatcggcaacggacaaagatgtttgaacgattgacagaattccaagcgccgcgatgagcagtactttcattttttcacgtgtccttgtggcggaccgggcaattcggtccgcattttacgatcattgttccaagtcaccgattgcaagaacagcgggtgcgtatttgaggtaccactgacgttggccagtgacaaggtcgcttgaactcttgagttgagtttcgggcatggaggcgaaactttcttccctgtggttaatgcgctgcagttggccgttgataaccttgtagagcgcccaccctttgctttccatgcacagacgactgccttcattgatgatttgcgcttcggagtcgcccaatgaacgccgtacctgcacaccttgaccgttcttgttgtaactggcgacctgaaattgaacgcaggcattcaggctttggctgaactgagcggatgaaggtttgttgttctgtgccttgaaatagacgctgccatctttgaagtccatatccgcccgatcggactcgacactttgtgcggtgcttgaataactgttgtgtggtgtcgagggggaagcacagccgttgagcaggctaccgaccaaggcaaccattaacagcgaaggggaaatgcgcatcgagacatccaaggaaaattgtatgagtgaatccgtattgccaacacggactcatgcaatttgcgattaactggctttggcaatcgccgctttcaaatcagcaagtccaaccaccaagggtgtgggcagcccttgtttttcagcggcgatgagccattcatcgagactctctttaactctttttgctgctttcaggagatctggcgcggcggtaatcagcctggcattagcgtttgacgccgtgccgaaactgtaacgcccttcatgcaagtccacgctgctcatggagcagatcgaaaggttcaaactgccaggactgctaacttcggctgtctcatccagaacccaaggtcccggtgtatgtgtgaattcgctcaatagcctgctccgtgatgctcaatggttcgcgtgattcagggcggaccggacaacccggcccgcattttacgatcagctctggcagaagcggatgcggttgccgaaggggtcgtacacttccaggaccttgccccagtcctgttgcataacactcggacgtccgtatccgtagcgcttgttcaataattcttcgccgaacgattcgatgttatgcatcggcacaaacaccgtcgagcctggacttgcatcgccatgatgttcggaaagatgcagttgcaggccattgcggctgatccccaggtagagcggtagatccgcttcgaaccggtgctcgaattcgacactgaaaccgagaaagtcgaggtagaactcgcgggctttggtttcgtcgaaaattcgcaggataggaatggctttatcgaaggtgattgcggattcgggtagtgccgcaggcagcattgccgatgcggtattccagtccttgtaacccaactgctgcgcgactgtttccagtgctgcgcaatgggtcatcgcttgatcgcgcgactccagtgcggcgcgcagccgtttggccatctgcttggcttgttcgattgaaagcatcgtatctcctgtggtcgagatattctggtgctcgcgttgccaaacctcgacttcaagaaatgcgcagggatttggggaaaagaagcaatgctttcacctttcctttcggaagcgagcggcaggcagcatcagcctgcgccgatgatacacagcggcccaacacaacgaaagccgctcccacgcccctgtaggagctgcggcacgctgcgatcttttgatctttgaatgcaagatcaaaagatcgcagcgtgccgcagctcctgcaagagcgtttgcaaaaccaggccgggacgcgccttcactcaccacaggcgcgcttcagcttcatcgaatttatcggcgactttcaaaaaagtatctgcccatccgctgctgagactgagctcttgaagcggtccagtaggagcgaaaagcacggcgatgtgaagcttgtcgggtagcgcgccagctctgagcgaatgaagcagcaactccagttcggtttttgccgcatcctcatccgcccacgaagaccagctgaaatcattgtcaggaagcgataccaactcgatcgaggcttccagtacctggatgagtagttcacgaggactgctgtgctgtgggaggccctgaaccaactgtttcgtactggtagttttcataacgcatccttggcctggtagtgcagatgtttgagtgacttcgcagttggtactcagcttgcggggcgcagcagcaagatgccctcaagcctgggagcgttcgatctcatgggccagtcccgcagctttctctcgcaacttgctgaattcttcgttcagctcgacatggtctgacttccatgaaagcacccgaccatcaaagcgctggccgagaacgacgtcgttgaaagagcccatcccgccataggccttcaatagatactcgatccctgaataatcagactgcaacaatcggcttcgggcgttgcgcatccacaagctccagtgagtatcaccatcgctctcaagcaacgttgcgagctgctcaagcgtgccgatcagctcttctgttttcggtcccattgctgccttcgccaatgaagttttagcgcttactttatctgaaacacactggaaatgagcttcaatgccttttccccatcagcctcataaagtccgtgcaaatgcgtctgatcagaaagttgatacaggcggaaatggttataaaacgcttgcccaagccgctgactctggaacttgccctgacgccaaagactgagaaagtcagcataggcagcactctcgatttcaagtcttaaaggtttgtccattcaagccaccgtctcgaaaaagtgtcagagcaagctccacgaaaccccgacataaacccccatcccttcacccggcgttgaacgcgcggcatccagtcctttgtcgtcataacccggcgtaactgtcgccgcgtagtgcttgttgctcaaattgcgcatgtccagccaaccttgccagtcgcccttcggcgcgttgtagccgagggtagcgccgaacaatgcgtaaggatcggcgtaataactgtctgcgtaatccacggcaactttggaaaccagttgggtatttaccgcggcgaagaaaccttgcggccagtcatagcgcaattcaccctggtagtagtgcatcggcaagcccggcaagcggttgtcaccgaagcgatcatcgtcgcggtagtggaaatcgctgaaggtgtaggcctgacgcaggctcaactggcggccatcggcagccgaccagagtttgctgttgaggctggcttcaataccttggtgcacagtcgggctggcgttcaactcataaggcgtgatggcattggcatccggcagcaccgagagcagctcatgccgcacttgcgcgtagtaccacgccaggctccattcgccaacggcactgtcgccgcggccacccagttccagcgtggtcgctgtctggttttgtagtttgaccggatccttttgcgtgccggttgccgcgccgttgccggccgggaagcgcacgttggagctgtagatcagcgaccacgggtgcggtgcttcgaccgagcggctaaggttgccgaacacttgcagatcggggttgatctggtagcgcagaccgatacgcggggcatagtcccagtcgttcatgctggttttgccgccgctctgcgggtaggtcacgtcactttctcgacgggtgtagatggcggcaagcccggtggtcagccagaggtcgtcggcgagttccaggtcattgcccaagtgcagaacggtgtccgaaccctgatacgtgaagtcgcgcatttttgtgcccgacgcataaccggcggtgttgccggacggaactcgcacgaattcgctggcgccgtcattgggcaaatgtttggtcacgcgcaagccgagattgctgcggctttccatgccgaaaatcgtgtcgcggcgtttgtaatcgaaggtaccgctgacgtcggtgtaggcgactttcaggcggttcgggccttcgcgcaggtccatcgggtaatcgtgatagaccaggccggtctggatgctcgagtcgtcgtcgatgtaccaggtggttttgttgccgatgaacgtgctgcccggttgcttgcggctgtcgtcgcgcgccacataggacggattcgccgctcgcgacgagtgttcgatagagtgcttggtcacgcggccggcgaggtcgttgtcggtttcgcggtagcggatgtagaagcgcgtttccaggttcgggttgaagcgatagccgaagttggcgatcacgcctttgctttcgctggcggtgtgatcctgataaccgtcggcgttggcgtcggtcagcgacacgtaatagtcgaagtcgcccagtacttgtcccgaactgacctgacgctgctgataaccatggctgccggtggcgtaacgcacttgcagtttcggcgcgttgtaaccggtgtggctgacgtaatcgatggcgccgccgagtgccagcgagccgcgatcaaagccattggcgccgcgcaacacttcaacgtgatcgacccacagtggttcgagcaattcatagggtgtgccgccggggccagtcaacggcaggccatcgagcatcgtgaacagccccgaggcatgggcgcccggtgcgcggttgatgcccgaaccacgtaccgaaatcttcaccccttcgttgcccgccgactgcgcataaaccccaggttgatacgccagcacatcctgattgctcgccacgcggccctgcaaaggctggcgcatatcgacgacgttggtgccgccgggcacctgttcgagtcgggttttggcttcttcgacgcttgcgtctgaaccgctttgctcgtcggccgaaatcagcacttgccccagttccagaccttgagtctcggccattgccgggcaggcgagggccaggcccagcagggcggtgggcagggatttggacgcgggcatcgaaaaaactccaggcagacaagggcagggcaatgaacagtgcgacgcaagaaagaacgaaggaaacacatggcaattttgctttttgccgggtcatggcaaacggcacgtcatgaactaacctcacgtgtctggtttgtcccgtcaatcaacactctgtttctgcatttattggagagaggccaaggtcatggcaaaaggcaaaaagaaggccgccacggcgcctgaaagtctgaaactgaaaaacaaggattacctcgagcatttgcgcaaactgcacgtcgaactggtcaagttgcaggaatgggtgattgccaagggcgtcaaggtctgcatcgtttttgaagggcgcgatggcgctggcaagggcggcacgatcaaggcgttgaccgagcgcgtcagcccgcgtgtctttcgcgtggtggcgttgccggcgccgaccgatcgcgagaaaagccagatgcacgtgcagcgctatctgccttatctgccggcggcaggcgaagtggtgatcttcgatcgcagttggtacaaccgcgccggtgtcgagcgggtgatgggcttctgcaccgacgaacaggctgacaaattcctcaaatcgattccgtgggtcgagcacgccatcgttcaatcgggagtgatcctgctcaagtactggctggaagtcagccctgaagagcagacccgccggcttgaggcgcgaatcaacgacggacgcaaaacctggaaactgacgccgatggaccttaagtcctacagccgctggtacgactactcacgggcgcgggatgaaatgttcaagcattccgacaccgaacacgcgccgtggctggtggccgattccaacgacaagcgccgcgcccggttgaatatcattaccgatgtgctcagccgcattccttatgaagatgtgaaacgcgacaaggtcgaattgccgaaacggcagaagccgggcaagtaccgcgatccggattatccgtataaacgcgtagcggcaaagttctgacgaattgcgccagacacagtgggcggctggccagcaaaaaaacctgtaggagtgagcctgctcgcgatagcggtgtgtcagccaacacatccgtcacagacaatccgctatcgcgagcaggctcactcctacagaggcggtggtgtattcatcattgctgatcggcgaagccctttggaaacaagtagtccatccgtcgactgcgctgaaccatcgcgatctcgtttctttctacccgtggagtccttcacgagatcatccctgatgttcgatcagcgcaaacaagacaaattggcggcatggcgaaaactggcgacgcaagcgcagatgcgtctggacccggaacaacagtacgacgaactgctcaaggccgccgatgaaatggaagagcaaggtctgatcaccagcgccgagtggcggcagttggtgcgtgatgcgggcaatgtgtttaccgccgaattgggtcgatcacccagctaaaacgctcaggttacccgacccttttttgatttcagctgtacacctctggagtcctgcaacagccgagcaaacgcgactttgtcgatcggccgactcatgaagtaaccctgcacctcattgcactgatcgaccccgagaatgtccagttgctcttcggtctcgacgccttcggccgtcacggtcaggcccatggctttgcccaggccgatgatcgcctgcaccaccgcgcgatcattggtgccgctgctgatcgaggcgatgaagcgcttgtcgatcttgatcccgtcaaaaggataagcgcgcaggtaacccagcgatgagtagccggtgccgaagtcatccatgttcaggcgcacgccgagttctttcagggcattcatggtggtcagggcgccgtcggtgtcgttaagcatcacgttctcggtgatttccagttccaggcgactggccgggaaacgggtttgcaccagcacttcgcgaacatcctcgaccacatcgctgaccgcaaactgcgcgggcgacagattgaccgagagcagaatgtcttccggccagcccagcgcggtttcgcaggcctcgcgcagcacccagcggccgagcgggacaatcagatcggtctgctccgccagcgggatgaacaggtccgggccgagcaatcccttggtgggatgctgccagcgcaccagcgcttcgaccgaaacgatgtgcttgccatcgatcttgtagcgcggctgatagtgcaggatgaattcgttgtgtttgagcgcgtggcgcaggtcgtcttccatctgccggcgggtctggatctgatcgctcatgtgcgcttcgaaatagcaccaggtgtttttgccctcggatttggcttgatagagggcaatgtcggcgtaacggatcaggtcgctgggtatgtagccgtggcggcgactgagggcgatgccgatgctggcgccgatgtgcaacggatgctgctcgaagaccaccggttgatgcaggctgccgatcaggcgggtgcagaacttgtcgatttcatgatggctgtccatgccattgagcaccacgatgaattcgtcgccgcccagtcgcgcgacgatgtcatgttcgcgggtgcactcacgcaagcgcacggcgacttcctgcagcacagcgtcaccggccgggtggccgagcgaatcgttgatcggtttgaagttatcgaggtcgatcatcagcagcgacaatggcggcgcgtgctccttgagcagcagggcttcatccagataacgcgcgagtttgttgcgattgggcaggccggtcagggcgtcgtgcatcgacaggtgctggatctgcgcatgggcggcgacttcgtcggtgatgtcgctggcggtaccgcgatagccaatgaccgcgtgcttgtcgaagatcggccgcgcggacagccgacagtggcgctgctggccggagtggtcacggtaggtgcaacgcaagtcactggcgctgctctcctcggtgaggtttctcagccacagttccagtggcgtggtgtcacaactcaacaggtggccgatgtcttgccccaaccacagggtttgcgggtaaccggtcacttcgctgaagcgcgccgacaggtacgtcagcgcgagggcgcgatcgacctcccagatccagtcggacgcggcttcggccacggcgcgaaagcgttcctcgctggcttccagctcacggttggcgttttctagcgcctgattggaggtttgcatgacggcaaaactctggtcgacgtactgcgatgaacgcaaggcgtgacggaaaaagtacgcggtcagcagcatcagcaccacaatcgtcgcgccgagtggcggcagcaatgaccacaataaatgttgcccgggccgttccagatcagcgatcaggctgtaaccggtgctgtccagcggcacccgagggcgctgcgggtcgatggtctcgtccggcgccagggtcaggttgctcaagccatagccgctgccgatcagacgcaatttggttggggtgagtttgtcgacgaacaccagcaccgatgaggtctgagggtcgccaaggggccgctcatcgttgggaatgatcgccgccgccgacaccagcgccggccagccttcgaacagtgaatagcggctgaccggtttggtcagatcaccttggcccaacacttgatcgagtaactccgtggcgctcacctgaacgaacgcggacagctcggcatcgaccatttgcccgcgcacgaccgcgtaacgggtgccttcgcggttcagcacgaacacgccgtcatagccgtcactggtgaacagggttttgccgaggttctgctcggtgtaggcccaatcggtgtcgacctgaccgctcaaatgctcgtaggcggtggtccagtaggcgtagctggtgatgtagtttttcgaggcagtgatgcggttttccagcgcgcgggccgagtaaaagcgggttttgtcgatttcctcgctatccagcgcattggcaattcccaacaaggcgactgtcgcggcgatcacaccgctgacgaacagcgcgccgacggcgatggccagacgccgggtaacggcgctttggcgcggtgggagaggggccgcataactggaaatgtccatgtgctcgtccttgatccgctgtcttctgaatctagaaccctggcacgggcgcaatgttcagattcttctgggcgactgcactgaaagcgtagtgaaacccgcgcgaattgcctccccaagtgcaggacgccgatcagcggccaatcccgaaagggcaagacttcccgcgcaaaaaccggataatggcggccattcgtttagccgtattctggtaatcccgcatggaaatcaaggtaaactttctcgacaaccttcgacttgaagccaagttcgacgacttcacggtgatcgccgatcagcccatccgctacaagggcgatggttcggcaccggggccgttcgactactttctggcgtcgtcggcgttgtgtgcggcttactttgtgaagttgtactgcgacacgcgcaacatccccacggaaaatattcgcctgtcgcagaacaacatcgtcgacccggaaaaccgctacaaccagatcttcaagattcaggtcgagttgccggcggacatttccgagaaagatcgtttgggcatcctgcgctcgatcgatcgctgcacggtgaagaaggtcgtgcagaccggccctgagttcatcatcgaagaagtcgacaacctcgacgccgatgcgcaggcgctgttgatgccggttgcaggttcggacgctggtactttcattgccggcaaggatctgccgctggagcagaccatcgccaacatgtcggggattctggctgacctgggcatgaagatcgaaatcgcctcgtggcgcaacatcgtgcccaacgtctggtcgctgcacattcgcgatgcgcattcgccgatgtgcttcaccaacggcaagggcgcgaccaaagaaggcgcgctggcctcggcactgggcgaattcatcgagcgcctgaactgcaacttcttctacaacgaccagttctggggcgaagagatcgccaacgccgagttcgtgcattacccggacgagcaatggttcaagcctggcccgaaagatgagttgccgacggaaatcctcgacgagtacacccggaagatttacaaccgcgatggcgagctgcgcggctcgaacctgttcgacaccaactccggcaacactcagcgcggcatttgctcgctgccgtttgtgcgccagtcggacaatcaagtggtgtacttcccgtccaacctgatcgaaaacctctacctgagcaacggcatgagcgctggcaacaccctcgccgaagcgcaggtgcagtgtctgtcggagatcttcgagcgcgcggtcaaacgcgaaatcctcgaaggcgaaatggctttgccggacgtgccgcaagaagtgctggagaagtacccgagcatcctcgccggcatcaagggcctggaagagcagggcttcccggtgctggtcaaggatgcatcgctgggcggcgaattcccggtgatgtgcgtgaccctgatgaacccgcgcactggcggcgtgttcgcctcgttcggcgcgcacccgagcctggaagtggcgctggaacgcagcctcactgaattgctccagggccgcagtttcgaaggcctgaatgacttgccgcagccgacgttctccggtcaggcggttaccgagccgaacaactttgtcgagcacttcatcgattccagcggtgtggtgtcgtggcgcttcttcagcgacaagcctgatttcgaattcgtcgagtgggacttctcgggccagggtgaaaactccaacgccgaagaagccgcgacgttgttcggcatcctcgaagacatgggcaaggaagtctacatggcggtctacgagcacatcggtgccaaggcctgccggattctggtgccggattactcggagatctacccggtcgaagacctgatctgggacaacaccaacaaagccctgcaattccgtgccgatattctcaacctgcacaacctgagcaaggtcggcctgcgcaatcttgcccaaggcctggaaaacagcgagcaggacgattacaccgagatcaccacgctgatcggcatcgagttcgatgacaacacgccgtggggcaagctgaccattctggaactgcgcctgctgatctgcctcgccttgcagaagtacgatcaggccaaagacctcgtcgaagccttcctgcaatacaacgacaacaccgtcgagcgcggcttgttctatcaagcggtcaacgtggtgctggagatggaactggacgaggatctgcaactggaagactacgaagccaacttccgccgcatgttcggcaacgagcgcatggacgcggcgattggttcggtcaatggcagcgtgcgcttctacggcctgacgccgaccagcctgaagctggaggggctggatcggcatctgcgcctgatcgagagttacaagaagctgcacacggcgcgggccagttttaccgcccggtaaatgaaaacccgtggtgaggaatgccttcaccacgggttttgcgttcactgcaacggcacgtagatgtccgtttgccattgctcttgaagcgtctcgggatagccgctctggtaacagaaaaacagcggctgatctctgagtgcgctgggtttgcagtgcatggaataacccttaggtcatggagatccctgaatgcctgaaaaaatcgtcaaatccaaactggtcaactttctggtggccgacgttgaagtgaattacgaagaggtcggcaatttctacgacagcgtcggcgccggcaatgtgaacgtgctggccggggtgatgcaatcgttccagcaagcctatggtggcctgtgggtcggcggcagaatgcgattgaccaaaaccgcactgcacctcaacgccaacgccatgaatcgcttggtgcaggacggcacgctggacatcgagattccgatcggaatgatcaagggcgtgtgcatcgacggcggtttcatcactcggatcatccgcctggataccgatgccgggtgcgtgatgtttcgttgttttggcgcgaaggaagtggttgcgctgatcgaaaagatgatcgtgccgcgtgtttcgttggcggtgctcaagcggggaatgcatcgaaatcagtgaaagatttggcgatcacctggcgggcgaaatggccccaagagcgccttctagcccctgaaaaataataactggctgttttaaaacaaatttttttcattttttgcttcacagatgcgacgaatgttggtaaattgccgcgcattcgcacacagacagttacacggtgtgagatacaggggcgtcgccaagcggtaaggcagcaggttttgatcctgccatgcgttggttcgaatccagccgcccctgccatattcaagaaaacgccagttcgcgagaactggcgtttttttatgcctgcgatgtgttaaatgctggatctgccgaggccatcgcgagccgatccagcccattcaccgtcgattcaacctgccaactcgacttcctgcccccgcgcccaatccgccaccagccgcgccggtgtcccgcacaccttgcgcttgtagacgaagtggtggcatttctcggcaaacccgctgcggttgtagagcatgtcttcctgcatttcttgcagctcgctgtcgcggcattgctcaatcagcacttgatcaatgcgcgacttgcgctcgcgcacggcggcgtaggtcggatcgctaagcacggcattggcgcgttgcagcagccacagggcaaactcatccgggcagcgcgggccgacttcctgaaccatgcccaattgcagcgcctgatgggcgctgaccggcaggcacgcctgggtcaattgctcggccattgccggtccgactgcgcggggcaggctgtacgtccagtattccgagccatacaaacccatgctcttgtagtgcgggttgagcacgatgtcggcccgcgcgaagacaatatcagccgccaacgcgagcatcacaccgccggcgccggcattaccggtcacgccactgaccaccagttgccgcgcactcaacagctctgcacagacatcatcgatcgcctgaatattcgcccaggcctcggcgccgggatcttgcgccgcctgaatcacattcagatgcacgccattggaaaagctgccacgcccgcccttgatcagtagcacacgcgtgtcgcgcgacttggcccaacgcaacgcttcgaccatgcgctggcactgctcggtgctcatcgcgccgttgtagaactcgaaggtcagctcgccgacatgccccgactcccgataacgcagcggttgatacgcctcgtcgctgaacggctggctggcgatcgaccagtccagtctcggcacatcggccaattgcccggcgagcacatgccgcgccggttgcttaaaggtttcttcacccggttgtggtttgcgccgtagcgaaccgagccacacgctgtgatcgcctgccgccaccagtaccgcatcgtcgtgcacagcgagaatctcgccgggcaggccgctgcgcgtatccagatgtgcgtcgtacacgtaatactggccgccggcgaggcttgccaacacccccggttggccatcggcagcatcgatgctgcgtttgatgaagcgggcgcagtcgtgccagctgaagctgcgatccacctgtttcatgttcggttgcaggcggccgcggacagtcggattagcgtaatccagcggcaccggcacaaagccgtcgacgaatttctccaccacctcgcgaatgcaacgaatcgccgcatcgctgacccgaccgttgtacagctcggatttgcgcagccccgacggcagattgaattcgcacgtcgcccagaccgggccagcgtccatttcctccaccgcttgcagggcggtgacgccccagcgtgacagttcgttgctgatcgcccagtccagcgcgttggcaccacgatcgccgacgatgcctggatgaatgatcaccaccggacgttgcgtgttgcgccataacgcttgcggtacgcgatccttgaggaacgggcagatcaccaggtccgcaccgctgtgttcaatctgttcgcataccgcggtttcgtcggtgaacaggacgacgctgggcgagtgcccggcctgacgcaattccagccaggcgcgttgcgtcaggccgttgaacgccgacgacagcaggatgatgttgagtggtcgcatgaatgttcttccttgaatgggatcagccgcgggctcccagtgagccgtccctggccttcgatggagccggaagattaatcagtgtccaggcgtgcactcgtgaccggggtcaacgttatgttggccagcatttctgcggtgatgaaaggtgttatgcaaaatagtttgtttatgatgattttttattccttcaaatgttttcgacgctattgcacagtcgcgcctgatcagagccggaagatcccggcagaacgatgatttttcgcagcgggtggaccccgtttcagggagcaaggcatgggtgggcataacccgcattaccagatcattgggcaaatgttccaaaaggactatcgctggctgtgcgctgctgtcggccgcacgttgggttgcccgcacggtgcgcaggacattgcatcggaaacgtttctgcgggttctggcgctgcctgatccaacggccattcttgagccgcgcgcactgttgaccaccattgcccggcgcttggtctatgaaggctggcgtcgccaggatctcgaacgtgcctatctggaaagtctggcactggcgccgcaaccggtgcatccatcgccagaagaacgcgcgctggtgatcgaggcgttgctggcggtggatcgcctgcttaacggtctgtcggccaaagccaaagcggcgtttctctatcaccagctcgacggtttgacttacagcgagatcggccagcgtctcggcgtgtcgaccagtcgcgtgcagcaatacatggttgaagcgttcaagcgttgctatcaggcgatgcaggcatgaggcccgacgaaacgctggtcgatgaggcggcgcaatggatggcgttgttgcagtcgggcgacgtcagcctcggcgagcgggcggcgttcgatgcctggcgcacggccgatccacggcatcagcagatcatcgagcaaatgggcggtgggttgaaactgttgcgcaatccgagcctgagtggattgccacgcaacagtctgctgcacagcctgaatgcgccgtcgagtcgtcggcgttttatcagcggcagtttgagcgtgctcggtgttgccgtgttggccggtttgctcggtcggcgttacggctggctgcccgaagcgggtgaactgtcgaccggcaccggagagcggcgcgatttcaccctgcaggatggcagcgcgttgaccctcaatgcgcgcagccgggtggtgcctttgttcgacagcactcagcggttgctggcactgcgcagtggtgagttgctggtcaacgtcgccaaggatccgtcgcgaccgtttgtggtcgagaccgaacacggtcgcatgcgcgcgttggggacgaagtttctggtgcagcagggcgacgattccacgcgtctggtgatgctccattcgcaggtcgaagtgctcacggcgggtggcgcgcggcaggtggtcggggcgggtgagagtctgactttcaacgcggctggcgtgctgtccatggagcgcagcagaggctacgaaggcgcctggacgcaaggtcggctggaggtacgcgaccgtccgctcagtgaagtcatcgacagcctgcgtcgctatcggcggggcattttgcatgtcagtccagaggtcgccgatctgcgcctgagcggtctctatccgctggatgacagtgaccgcacgttgcaattgctcgaacgttcgctgccgatccgcgtgacctggcacaacccctattgggtctccatcgccccccgcgccaaccccctgtaagcagctttcaagatctgcggcagcgcggtgcgttctattcggttatagggatatgacttcttggcctaaatgccggcctataaaaagcgccggcccgctgctcattccctgcagatgccttcaacagggaagcccctcgatgttctcattcaaacaacaattacctcgactgaccctcgccgctgcactggccatgggtgttgcgccgttgccagcgctggcgcaggaagcggtcgcggcggtgttcacgttcgacatcgccagcggcccgctcgacgaagtgctgctggatatctcgcggcagaccggcgtgccgatttccttcagtcaggatctcgtgcaaggcaagcgcagcccggcggtgcggggtgccttgggtggccggcaagcggtggaaaaggccttgctcggcagcggcctgcacgtcgagcagagcaatcagggtttgagcattcgcgaaggtgacgctgccgtaccagtgccagccaaagtcactgccgtggcgcccgtcaccaacgccgattaccgcatggaaaaagtcaccgtcaccggctcgcgcatcgcccgagcacagagcgacggcgcgacgccggtcaacgtcatcacccatgaagaaatggaagcgcgcggctacaagaacgtctacgacgccttggccacccagacgcaaaacaccggcatgacccaaggcgaagactacggcaacacctggcaaccggccgccagcgcgctgaacctgcgcggcctcggccccaaccatacgctggtgctgatcaacggccggcgtgtggcggattaccccacgccgtacgacggcaaggtcaatttcaccaacctggcgaatattccttcagcggtgatcgaacgcatcgaaattctcagcagcggcgcctcggcgatctacggttcggatgcgatcgccggggtggtcaacatcatcctcaaagacaagatcaacggtgtcgacgtcaacctcaagggcggcaccagcgagcgcggtggcggcgataaccagcgcttgcagatcagcggcggcggcagttggggggatttcgacggcctgttcggcctcgagctgaccaatcgtgacccgatctgggccgatgaccgtggcttcatgcaaagcggcccgttggcggatgtcggctaccgccgcgatctgagtaacagtcgctatctcggcccgggttgcggcgcctatcagggcacgttcgacaacaagctgttcaacagtggcgggcgttgccgcaccgatcagatgtacaacgattactggaccgtgcagacccagaaggaaaactacgacggctacacgcgtggcacctggcatttcagcgacagcggccaggtcttcgccgacttgatgtacggccttgaccatatccagaacaacacccgtggcccgaccttcacctcgccggacttcatcaatcagaacagcggcaatcttgagcgctggtatcggcgcttcggcgaagaggaaatcggcgggcgcaccagcaataacagcaagtggcgcgacacgtcgtggaccggcaccctcggtctctccgacaagatcgccgacaccggctggagttacgatctggcagccaatcgctcggaatatcgcagcgtcaggaccacccgttatacgccgctatcatcgatccaggatttttacctcggtccgcagttgggcgtgagcggcggttatccggtgttcgccccggatgcctcgcggctcgaccggccgctgacgccgcaggaatggcagcagtttcgcggcaacctgacccagagcagcaaatcggtgtcgaccagttacaacgcttcggtcaatggcgatctgtttgatctgccggccggcccggtggggtttgccggtgtgctggaggcgggcaagcaggaataccgcgtcgacccggatgacggcctcaacgatggcagtttctacggcgtcagcccggcgcaaagctccggtggctcgcgcaagcgttatgcggcgggcggcgagttcagcattccggtcaccgacaccgtgctggccacggcggcggggcgttgggatcagtacaagttcagcggtcgcaccgagcaacagaaaacctacaacctcggtctggagtggcgtccggtgaccagcctgttgctgcgcggcagttacggcaccagtttccgcgcgccggacctcaactacatctatcaatccgacagcaacggttactacccggcgcagatcgactactacggttgcagccagggcgtggagggcgcctgtgatcgcgggcgggtcgattacacccagagcggcaccgcgaatctggagtctgaacggggtaaatcctggacgtacgggtttgtctggtcgccgtcgcgcaacttcgatttctctactgatttctggcgtgtggagatcgacgacttgctgaccaccgtcgacgaaaaccgcttgctgcaagaagaaaacgaatgtcgcaatggcatccaggacatcaactcggccaattgccaatcgaccctggcacgcatcgatcgcaacgccggcaacgcggccattgatccgaaccagttgcagcgcgtgcgagtgaatgccatcaacgctgccagcgaacgtgtcagtggcctggacttcaagagcaacatccgctggggcgccgggcaatacggcgccttcagttcggcgctgggttacaccctggtgctgtcgcattactacaaggagtcggacgaagcaccgacccaggattggcgtacctcgcgcaccaactacgactggcgcagcaaggtcaacgccagcctgacctgggattatcaaaaagccacggcgacgctgatgggcattcgctacggttcggtcaccaatggcgcaggggacgggcgtttgtcgccctggacggtgttcaacgccagcgcacgttacaaactcaatgatcgggcgagtgtcgggctgaccgtgaacaacctgctcaatcaggttaaacacgatgagtcggcaggctggccgtactacccgaccggcaactatgacccgtacgggcggcagtggtggctggatgtgagttatcacttcggcggctgagggcaggcatctcgcgtttacgtcctacggaaaatggcgagttttgcggcaagcaggggatttttccgacgaccttttcaggttggtcgtcggaagcgcgatctatagcattggatctgacattgaagtcgctgagcagcttgaacgctcaggctcccagataaaggatcgattatgcgtaccccactcattgagcatgaaacctctgtttattccctgcgcaacttctggatcgacgatcgcgccagatgccccatggaggatgtcgcgatgtccacagcaaaagtgccccggctgacggggctgaagaaggtcgcgggcaagcctgtcgagctactcgtgaacggccaggacctcggtgacgacgccatgctgattgtccgccttaccgaggagggctttgagctgagcgacgtcgtcaacatgctttcaacttccgaaatgtacctgcgcgaagacatggtcaaacgcatcaccggcaggtctgtcagaaccgtgcagcggctgttgaaggaaggcaaatcgatacggcttgactcgcagcagagtgttgtcgcctaccaatatgcgctggtgctggagatggccactcgtgcgttcggggggctgtcacaggcggaaatatggatgcagaaatccatcccttaccttaacggctacgtgccgttggagttgactcaccatccgctgggtttccagatggtcgagcaatacttgtgtcgggttctgtatgggggttacccatgaatcctttgccctgggaaggtcactggtatggctggcgcctggatcaggaggcctatggagatacgtgggacagcgggatgggttcaaaactgaagggcggtcgatggaatgcgcctggccggcgagtcgtctatgcatctgttgatccgtcctcggccattctggaggtggcggccaataatagttttgatgcactggacagagagccatatgtgctgacgtgctttgaagtcatccgcgatgcacgggtcaaagtcgttcagcctgaagaggtaccgaatccttactggttgagtcccgcgtggccgtcgcccaatcaacagcggtttgccgacgctttactggatgaacatccgtttgtcctgattccctcggcggcaacccgccactcgtggaatctgctggtgagctgcgacctggcagcggggcagttcaagatggtctctcaagaacgttttggcctggatacacggttgctgcgggagatggcatcggcttgatatggaggcatggcattctttgcataacctcagcacccaacagtctaagtcgccctctataaatccttattcgtcattgcacatccctgcataaaccaaaacgcagggatggctgttcatgattcagttttcacccgttaaatcgcctttgagcctggccttgctgctggctatcaacacgctgccggccatcgccgctgacagttcggcaaacgaacccacgacccagctgcaacgggtggaagtcaccggcacggcaatccgccgcgtcgatgccgaaaccgcagtgccggtgaccatcctgcgcgtcgaagagttgcgcgagcagggcgtcaccaccaccgaggagctggtcagccggatatccgccaaccagtcttcggttggttccggtcgctcggtagggtcgagcagtggcggcgcgtcgtatgcggatttgcgtggcattggcccgaataaaaccctggtgctgctcaacggccggcgtctgagcaacaacgccaccaatgcgatcaacggctcgggtgtcgatctcaacaccatcccgttcgccgccattgaccgtgtcgaagtgctgcgtgatggcgcctcggcgttgtacggcaccgacgcgattggcggggtgatcaacttcatcaccaagaccagccttaccgaagggcagatcagcaccaactacgacacgccaacccattcggggggcggtgaaagccgcaacttcagcggcagttggggcttcggtgatttgcaggaggatcgcttcaacgtgtttggtgtggtcagctacgacaagcagcaacgcctggccgctgaggatcgcggctacacctacaactatcagcccaaccgcggacttgattacacctccggcaccgcctcgccggccaactggagccagggcagtaacgccaccaaccctttggccggttccggttgcaacgcaccgggtttgctggcgcgcaacggcatctgccggcagagcctgtggaactacctcgatctggtgccggaaacggagaagacttcggccttcgccaaagccaccggcaagctgtcggacgatcacaacgtcagcctcgaatacttctgggcgcaaaacgaaaaccgcacgcaaatcggcccaggcacgttgatgggtaatcaggtcaatcccggcacggcgttctatccgggcaacggcatcaccccagggccgaacggttttgccctcgacccgacgcaaccggtcgatgtgaactggcgcgaaaccgccgttggcgcgcgtcagcacgaagacgacaacaccagtcagcgcttgctgctgagcttcgacggcacgctggtcggctgggattacaacctcggtgcctcgtacaaccagaacaaagtggtcaacagcattcaggacggttacgtcaacgaccgcgccgtcagcgccggtattgccaatggcgtgatcaacccgttcggtccgcagacggctgccggttccgcgctgttggcggccaacgcggtggacggtgattacgccacggcggtagggcgagtgaaggccatcgacgggcgcatcagtcgtgaaatcggcgactggttcggcgccggcccttcggcattggcactgggcggcgagtatcgcaaggaagacttccatcaggatttcgcgcaatttgccggcgacgtgcaaagccttggtgttgatccgaacggcagcgttgccggggatcgcagcgtttccgccgagtacgccgaggtcaatgtgccggtgctcgacagcctcgaactgtccgccgccgtacgccacgacaagtacagcgacttcggcagcaccaccaatccgaaatactcgttccgcttccagccgttcaaggaactggtggtgcgcggtgcctacagcgaagggttccgcgcaccgtcgttgtatgagctgtacaacccgacctttaccagtttcaccaatgccaactacaacgatccgcgcttgtgcgctggcggcaatccgagcaatggcggcatcgccaaccgtgactgcgcgcagcagttcaatcgcaccagcggtggcaataccgatctgagcccggaaaccgcacgcaacgtcacccttggctttgtctaccagccgttcgaacgcctgagcgccgggctggatttctggtggatcgacattgccaaccagattgccgagttccccgagtcggcggtgttcgagaaccctgaactgtacccggatcgcctggtgcgcaagccggatggctccatcgatcacatcgtcaccgggctggccaacctcggcaagatcaagaccaatggcgtcgatgtcagcttcgattaccgcttgccgagcacgccgtacggcaatttcggcatcggcctgcagggcacttacgtcacccgctatgactaccagcaacaactcaagggcgactacatcgacaagctcggcgatttccgtggcggtgactttgcgtcggcgggtgccgtggcgcgctggcgtcacagcctgaccggcagctggaactacggcccgttcggcgcggccctgaccaaccgctacaccagcggttaccacgactccgatcgcgacacccacgattacgtcggctcgtacaacgtctgggacttggccggcacctacacctggcgcaagaccctgagcgtgaccctcggcgcgaaaaacctgtttgaccgcgaaccaccgttcagcaaccagacgtacacgttccagagcggctacgacccgaaatacagcgacccgtttggccggacgctgtacacgcgggtcagttacaagttctgaaaattctcagagatggcgggttttagtcaccgattgatctaaagcctgccctataaaaatcgccggcctgttgcacatcacaggtaggcaggatgtgtggtgactgttccggcgttatcgcgagcaggctcactcctacattggatttgtgttcaccgcagacctttgtaggagtgagcctgctcgcgaagaggccagtagcaacaccgtgtaaaaggatctgcccatgttctcaaggctcattttattcagcgctttcgcgcttttaacgccgttcagttgggccgccctgcaaccagcgttaacggtgtacggcgaacccgccaaatatgcccccgacttccagcacctggcctacgccaaccccgacgcgccgaagggcggcagcctgcgccggtcttccctggaaagtggcccgttcgaccacctgattccttacaccgacaaaggcaccggcgtggccgacatcgatggttggctctacgcgcctctggcctatcgcagcaaggatgaaccctacagcgtctacggtctggtggcgcagcagatggagttggatccggatcgccgctggatacgcttctacctgaacccgaaggcgcgtttcgacgacggcacaccgatcaccgccgaagacgtgcgttacaccttcgagctgttcaccacccagggcagcctcaaataccgtcagcagtttcgcgatgtcgctgaagtcgtcgtggattcgccgacgcaagtgcgcttcctcttcaagaacaacgacagccgcactttgccgctggacctggcgacactgccagtgctgcccgaacattggtggcgcacccgcgatttcgccgagggcggcggttttgagatcccgccgggcagtggcccgtatcgcatcagcgcggtggatgccgggcgcagcgtgaaattccaacgtgtgcaggactggtgggccaaggatctaccgatcactcggggcttgtacaactttgatcagttaagcgtggagttcttcgccgacaccgacgtgtcgcggcaggtgttgaaggctggcggattcgattacaaccgcgaattctccgccaccagtttcactatcggctacgcgggggcggcgctggaacaaggcaaattgctccgtgaacatctcgcaccgggggcggcgcaaggcgcgcagggctttgtgttcaacctgcagaaaccgccgtttcaggatcgtcgcgtgcgccaggcgatcgccatgctctgggatttcgaatggagcaaccggcaaatgatgcgcagcatgtacctgcgccagcgcagcttcttctcccacagcgcactggcggccactgcattgccggatgccgaagagctgaagattcttgagccgttgcgcgggcagattcccgatgaagtattcaccacggtgtttgaagcaccgaaaaccgacggcagtggcaacatccgcgctgaacaattgcaggcactgaaactgctggaggccgctggctggaaacctcagggcgatcagttggtgaacgccaatggcgagcctctgcacttcacgtttctcaacggccagaagggtttcgaacggctgttgttaccgttcaaacgcaacctggcgcagatcggtatcggcttcgatatccgccaggtcgacaccgcgcaatacaccaaccgcgtgcgcaatcgtgactacgacatgatcgttgccggttatccggtaagtcaggcaccgggccgggagatgttcaattacttcggctccgacggcgccgacgatcctggctcaaacaattacatggtgttgcgcgatccggccgtcgatgcactgctcgaagggctggtgcaggccgacaatcgcgagagtctgctgcgccatgctcatgcgctggatcgggtgttgcagtggggctattactgggtgcctaactattacccgccgggaatttccacggtgtggtggaaccgcttcggccgtccggcgattgcgccgctgtatgacgccggcctcgacacatggtgggaaatcagcccgaccgcactgaccacaacgcagatgcacaaggagtacggccatgtggggttatagcctgcggcgtttactgctgatcgtgccgaccttgctcgcgatcctgctggtcaacttcgttatcgtgcaagccgcacccggtggcccggtcgagcaggccattgcgcgcttgcaggggattggcgtgggggccgcggtgggttccagccatgtcgaaaccgtcggcggcgagtctcgcgccacccgggggctggacccgaaactggtggctgatatcgagcgtcagtacggcttcgataaacctgccagcgagcgcttgtggctgatgcttaaaagctatgcgcaactggatttcggtcagagtttctttcgcggtgccagcgtcaccgaattgatctggcagaaactgccggtgaccgtgtcgctgggcctgtgggcgacgctgatcacctatctggtgtcgattccgctgggcattcgcaaagccgtgcacaacggctcggcgttcgatgtctggagcagtgtggcgatcatcatcggttatgcgctgccgggatttctctttgcgctgctgctgatcgtggtgtttgccggtggcacggcgctggactggtttccggtgcgcggactggtctcggacaacttcgccgaactgtcgccgtgggccaaggtggccgactatttctggcacttggtgctgccggtgactgccttggtcatcggcggttttgcgaccttgacgatcctcaccaagaacagctttctcaacgagatctcgcgactgtacgtggtgaccgcgcgcgccaaagggctgagtcaaaggcaggtgttgtacggccatgtgtttcgcaatgcgatgctgctggtcgtcgccggtttgccgcaagcgttggtgacggtgtttttcggcggctcgttgctgatcgaagtgatcttttccctcgatggtctcggccgtctcagttacgaagcggcggtcgcacgcgactatccggtggtgttcggttcgctgttcatcttcaccctgttcggcctgctgataaaactgctcggcgacctttgttacacgctggttgacccgcgtatcgacttcaccgcgagggctgcctgatgctgacgttatctccaataggccagcgtcgttgggcgcgtttcaaagcacatcggcgtggctggtggtcgttgtggctgttcctcgcactgttcggcctgagcctcggcggtgagctggtggccaatgacaaaccgctgctggtgacgtatcagggcgactggtatttcccggcgttcaagcgctacaccgagcaggacttcggcggtgagttgccgtttcaaccggactatcgcagcgcgcaggtgcggcaattgatcgaggggcagggcgggcgaatgtggtttgcgccgattccgttcgcgttcgacacggtcaattacgacctcacggagccggcaccgagtccgcccagtggcgacaactggctgggcaccgacgatcaggcgcgcgacgtgctggcgcgggtgattttcggcacgcgcgtgtcgctgttgtttgccttggcgctgaccgcggcgagtgcgctgatcggcatcgccgccggggcgttgcagggctactacggcggttgggtggatttgatcggtcagcgcttgctggaggtttggtcggggctgccggtgttgtatctgctgatcattctgtccgggtttgtcgagccgaatttctggtggttgctggggatcatggcgctgttttcctggttgagtctggtggatgtggtgcgggccgagttcctgcgcagccgtggcctggaatatgtgaaagcggcacgcgcgctgggtgtgggcgatgcgcaggtaatcgttcgacacattctgcccaatgccatgagcgccacgctgacctatctgccgttcattctcaccggcgcgattgcgaccttgtcagcgctggattttctcggtttcggcatgccggccggcagtgcttcgctgggggagttgatcggtcagggcaagagcaatctgcaagcaccgtggctgggcttgaccgcgttctttgccttggcgctgatcctttcactgctggttttcatcggcgaagcctgccgcgatgcgtttgatccgaggacttgatatgcctgaacatctgatcgaaatacgtgatctgcgcgtcgccttcgacggccagcccgtggtgcacggcatcgacctcgatatccgccccggcgagtgcgttgctctggttggggaatccggctccggtaaatcggtgacggcgcacagcattctgcaattgcttgacccgaccatcacgcggatcgacggcagcatccgttatgccggcgaggagctgcttggcgtgcatgagcgctacttgcggcaattgcgtggcaaccgcatcgcgatgatttttcaggagccgatgagctcactgaaccctttgcacacgattgagcggcaactgggcgaaagccttgcgctgcacaaggggctggccggggcggcggcgcggttacggattttggaactgctggaattggtcggcattcaacatccgcgcgagcggctcaaggcctatccgcatcaactctcgggcggtcagcgacaacgggtgatgatcgccatggcgctggcctgcgagccgcagttactgattgccgacgaaccgactaccgcgctggacgtgaccgtgcaacgcaagattctgctgttgctcaaggagctgcaagaacggctgggcatggcgctgctgatcatcagtcatgacctgaatctggtgcgaaacatcgctcagcgggtggcggtcatgcgcggcggtctgatcgtcgaacaggcgtcgtgtgaacagttgttcagtgcgccgcaacatccttacagcatcgaattgctcaacgctgaaccgggtggcgaagcgttgtgccgggagcctgcggaggacgtgctggaggtgcgtgatctcaatgtgcgcttccgtttgggcggcggatggctgcgcgcgaagtcgtacttgcacgcggtcaatggcattgatttgaatcttcagcgcggcaagaccttggggatcgtcggcgaatccggttccggcaagtcgacgctgggccaggcgattctgcgtttgctggatgcccagggcagcatccgctttcagggcgaggcgctggagcagttgagcggcaagcaactcaggccgctgcgcaaacgcctgcaagtggtgtttcaggatccgttcggcagtctgagtccgcgcctgtgcgtggagcagatcatcgccgaaggtctacaggtgcatagcgatttgaatgccgctgagcgcgaacgggcagtgatcgatgtgctgcgtgaagtcggccttgacccggctactcgccatcgctatccccacgagttttccggtggtcagcggcaacgcatcgccatcgcccgggcgctggtgctcaagcccgacttgatcctgctggatgaaccgacgtcggcactggatcgcacggtgcagaagcagattgtcgcgctgttgcggcgtttgcaggcggagtatggcttgacctatctgttcatcagccacgatctggcggtggtgcgagcactggcgcatgacttgatcgtgatgaaggacggtgaggtggtggagcgtggcgagacgaatacgctgtttcatgcagcgcagcatccgtatacccgagagttactggccgcttcgttcaccgggtaaccctgtaggagctgtcgagtgaaacgaggctgcgatcttctgactttgcgttctaaaaaaacagggtcaaaagatcgcagcgtgccgcagctcctacagggccgaaacgcaagaatcccgccacagggggcgggattcttgtgtcactgaacgtcgctgttacgacgggaacagctcggacagtttcatcgacagcatcatgtcgccttcaacgcgcagcttgccgcccatgaaagcctgcatgccgtcggtttcgccgctgacgatacctttcagggtttcgctgtccagcaccagtgtgcagttggcgtccgggttttcaccttcctggatgtcgcaagtgccgtcttttacgatcagcgagtactgcttgtcttcgtcggtgatgttgaaaccgaagaccagatccaggccggcagcagcggctgggttgaacttggcttgcattgcttttacggcatcggctacggaggtcatggttcgatccttatgaggttgattacagcaaggttcacagttatccggactcagcggaaagtgatgagttccggagccttcagcagttgcaggtgtgcatgactgttgaaggaagccaaagccacctcacgaccgcgaaacttcagctggttgagcgaggtgttgacgatttgccagttcaattcaaaagcctgtcgggcaggcatttgggtaatgaggtggagcagggcagtgatggtgccgccggaagtgaacacggcgattttctggtttttatcggccagatcaaggatccggtgcagcccggcctggacgcgttcgacgaaacccagccagctttccagccccggcgtgtcgtaggtgccggccagccagcgttcgatgatcagggcaaaaatgcgttggaactcgccgcggttctgcgcggcgttgcgcaggatgtcgagggcttccggctcgtccggcagcatcgccgggagcagggcgcgaatcaccgcgtcggcatcgaattcgttgaacgcggaatcggtttccaggatcggcaccggcaggcctttggcagtaaattgctccagggcgctggtggccgtgtgctgctgacggcgcaggtctccggcgaggcagcgatcgaagctgatccccagttcagcgaggtgctgaccgaggatttctgcctgacgcacaccggtcggtgacaggacgtcatagtcgtctgcaccaaaggaggcctggccatgtcgaatcaaatagatgctgcccacgtccgcgtcatcccggtacgttgaaggtttggcgaggttatgaggatgccgtcgagctgtcaatgaaaaaacatacgcttgtttgaaatgcccgttacaggggtgttgccagaggtttcacggctggccgacgagccggcgcatgggtatgctggacttatcccgagcgtgtgttttgcacccgcgcattgttttaaggagtcgctgtggagtttttcaccgagtacgccagttttctggccaagaccgtcaccctggtgatcgccattctggtggtgctcgccagttttgccgcattgcgcagcaagggccggcgcaagtcggcggggcagttgcaggtcagcaagctcaatgatttctacaaaggcctgcgtgagcgtctggagcagaccttgctcgacaaggatcagctcaaggctttgcgcaagggcgaagccaagtccgagaaaagcgagaagaagcagaagaacaaacccgaggccaaacctcgcgtgttcgtgctggatttcgacggtgacatcaaggcctcggctaccgagagcctgcgtcacgaaatcactgcgctgctgacccttgccacaccgaaggacgaagtcgtgctgcgactcgaaagcggcggcggcatggtgcacagctatggtctggcgtcatcgcaactggcgcgtatccgtgaagcaggtgtgccgttgactgtctgcatcgacaaagttgccgccagcggcggctacatgatggcgtgcatcggtgagaagatcatcagtgcgccgttcgcgattcttggctcgatcggtgtggtggcgcagttgcctaacgtcaaccgcctgctgaaaaagcacgacatcgattttgaagtgctcaccgccggtgagtacaagcgcaccctgaccgtatttggcgaaaacaccgaaaaaggtcgtgagaagtttcaggaagacctggacatcacccaccagttgttcaagaacttcgtcgcccgctatcgcccgcaactggcgattgacgatgtcgctactggtgaagtctggctcggcgtcgcggcgctggataagcaactggtcgacgaactcaagaccagtgatgaatatctggcagaccgggcgaaaaaggccgaggtctatcacctgcactatgccgaacgcaaaagcttgcaggagcggatcggcatggccgccagcggctcggtcgaccgcgtactgctgagctggtggagtcgcctgacccagcagcgcttctggtaaatccaacaggcataaaaaaacgccggtcacatgaccggcgtttttttgtctgcgctaaaccttcagcggcgacggaacagcggcagcggttcgtcagtggcagcctgataggtcaccgagaaatccttcagaccttcaagggcttcgtacgggtctttatccgggcgcacggcaaaggcgtcaaaaccacagcggtgcatgtagaacagctgatcgcgcagcacgtcgccaatcgcccgcagttcgcctttgaaaccataacggtcgcgcagcaggcgggcattggagtagttgcggccgtcagtgaatgccgggaagttcagggcgatcacctggaactcggcgacgtcttcaccgatttcctcggcttcttcgtcagcgtccagccacacacccagaccgccgtcgcgggccttgagcatgcggctgtgttcgcgccacagctgcagtggcacgatcaggtcgtcgcagttgctgatctcgtcgatgttgaaatccttgggcagcaagtgccaggtttcgtcgacgacctcgttgttcttaatgattcgctgcatagacgcgttccttgaagaggtcgatgccaatacgctgataagtgtcgatgaagcgctcgtcttcggtacgttgttcaacgtacacgtcgatcagcttcgagatcacgtcaggcatggcttcctgagcgaaggacgggccgaggatcttgcccagacttgcgtcacggctggcactgccgccgagggaaacctggtagaactcttcgcctttcttgtccacaccgaggatgccgatgtggccgacgtggtggtggccgcaagcgttcatgcagccggagatgttcagatccagttcgccgatgtcgaacagatagtcgaggtcgtcgaaacggcgctggatcgattcggcgatcgggatcgacttggcgttggccagtgagcagaagtcaccgccagggcagcagatgatgtcggtcagcaggccgatgttcggtgtggcgaaaccgccttcacgcagttcgccccacagggtgaacagttggctttgctcgacgtcggccagaatgatgttctgctcgtgcgaggtgcgcagttgaccgaagctgtagcgatcggccagatcggcgacggcatcgagctgcttgtcggtgatgtcgccaggcgccacgccggtcggtttcagcgacagggtcacggcgacataccccggcttcttgtgcgccagggtgttgcgggtacgccagcgagcgaaacccggatgctctttgtcgagatcggccagttgcgcggtctggttttccagcgccttgtaatccgggtcgacgaagtgcttggccacacgctgcagttcggcgtcggtcagtgtggtctggccaccgcgcaggtgttccatttccgcatcgactttctgcgcaaacacttctggcgtgagggctttgacgaggatcttgatccgcgccttgtatttgttgtcgcgacggccgtagcggttgtagacccgcaggatggcgtcgaggtagctcaacaggtcctgccacggcaggaactcgttgatgaacgcacccaccaccggggtacgaccgaggccaccgccgaccagtacgcggaagcccagttcgccaccggcgttgtgcaccggctccaggccgatgtcgtggacttcaatcgcggcgcggtcagcggtcgaaccgttgacggcaattttgaatttacgcggcaggtaggcgaattccgggtggaacgtagtccactgacggacgatctcgcaccatgggcgcgggtcgatcacttcgtcggcggccacaccggcaaactggtcggtggtgacgttgcgcaggcagttgccgctggtctggatcgcgtgcatctgcacggtggccagttcagcgaggatgtccgggatgtcttccaccgccggccagttgaactgcacgttctgccgcgtactgatgtgggcgtagcccttgtcgtagtcgcgggcaatcttggccatcatgcgcgtctgacgcgaagtcagttggccgtaaggcaccgccacccgcaacatcggcgcgaagcgctggatgtacaggccattttgcaggcgcagagggcggaattcttcttcgctcagctcacctgccagatagcgtcgggtctgatcacggaactgcttgacgcggtcctcgatgatccgctgatcgtactcgtcgtatacgtacatataagtcctgttctcaggctttgggccactcggaaaacgctgcgttttcgcttgctggagtccgatggtgcctctgcaattctgcgcgcacggccgcgcactccctaagggagccggggcaatatacccgtttgcagttatgcgcaaaagtgatgtttgagtatatgtaaagaaccaaatcgcctaaagagaatggctgtcaactaacccacatttgtcgtgcggacaatcatcgtcttaactgtggtcgagtctttctgcaatcaccgataaaaccgataagaggcgatgcaatgagcaatccgaccaaggcaagaaaaagcgatagcagtgtcgatgcatgggccattttgttcctgatcattctggttgtaggaacagcggtattctgggtcagtcatcagtaaacgacccatccgggcccgcttccgacgattgtcggacaaaaaacgggatcaagcgtcaatagccgattgatcgatggctataatgcgcggccatatttccttgggcccggatgcttcatgttcaagtttctccatatcggtcttcttttgctgggcacagccttgggcaccagtgcgcgagcagaatcggtgctgtttttgaatccgggctcgaccgaagaagcgttctggatcagctactcgcagttcatgcagtcggctgcgcgcaatctgggcatcgatctgcagatcctctattcccagcgccagccggaactgaccctcgcccaggccagaatcgccctgcaggggcccaaccgtcccgactacctgatgttcgtcaacgaacagtacatcgcgccacagattctgcgtctggcgcagggcagcggcgtgaagttgttcatggtcaacgcagcattgactgccaatcagcaagcgctggtgggcgagcgtgcggaccgcatcggcagcctggtgccgaatgacgaggaaggcggttacctgatgatgaaggaactgattcgtctgcaccccccggttgccaaggatcagcagatcgagttgctggcgttctccggtctgaagatcacgccgtcggcgcagttgcgcgagcacggtatgcagcgtgccttggccgaacatccgcaggtgcgcttgcggcaactggtttacagcggctggacccagcaacgcgcatatgagcaggccaggcaactggtcaagcgttatcccgaggtttcgctggtgtggtcggccaacgatgaaatggccttcggtgccatgcgcgcttttgccgaggccggtaaaacccccggcaaggatgcgctgttcagcgctgtcaacacgtcacctgccgcgttgcaggctgtcgtcgacgggcggttgagcgcgttggtgggtggccatttcaccctcggtggctgggcgctggtcgagttgcatgatcatgagcttggcgtcgatctcgatcagtacggcggccgcgatcggcagattccattgctgcaacttgtcgacaagtctcacgctcgacaaatgctggtcatgggcaagtcgccgaactatggcgtgaacttccgccaactctcggcgaagggccggccagcctcatatcgctatccgttcaacctgcaaaccctgatgcactgagacgcttcaaaccccggcgaaatgcagcaccactttgacgatgaccaacagcgtcaaggcaaataccgccgtgaacagaatgcccagaatgacgaaatggccgggtttgccatgggtgaaatccctcgcccggttttttccgctctgcaccccgaacgccgcggccatgacgctgtgcagcatctgccagaagctgggtggcttgttgtcgactggatcgtccataaatcccccgtctgcgtgtgtgtcccagacagcatagtcaattcaccgaagagtgcccttgccgtgcgctgctcagctgaagcgattggtaacaactcatcgccgatgcgataactatgtaccgcagttcgccccggcaggaatggtgtcctgtcgttccacttttcaggagcgacagaatgaccattcatcccccgacgctgcccgcagctgcgcagtcttccaaccctccgttgagcctcgataaggagacgctggccagcgccagtcttcacggcaagcgtatcgagcagatggtccccgattggttgatcgacgccagccccgagcgccgcgctcatatcaagagcgcggacacgcaactaccagactggtaccaggcgctgtccgacgagcaacggcgcaatctgcaagcgcacatcaccgaaggctttcttgcccagtcgcgactggacaagagcatggcagcgcttgaaagcatcgaagcattcgccgaggctcagctgctcaaagcgctcaaggaccgattcagcgtcgagctcgacgtcaacaaaaccctgctgtgtctccggcatccgttgcaagtcagcgtgctggaaatcgaagtgtcgaccttcgaagtgttgaagctctccatgctgcaagccgccctgcacaatttcgaagcggctgaatgcgaggagggggcctttcatcgcgaatccggatttttcgtcgccgcttcgaccgccgatacgttccaggcggtgacactcaatatcactgtcagccagtttctctcgctgtgtcgaacactggatatcggcgcgctctatcagacgcgtgtgaaagcgtttttccagtcgagcggaacattgcgtgagcaattcatcagcagccagaaaaccgcgatgcgcgcagccgctgaactggcgttgcttaagaaggacatcgagccagacgactatcgaatgctcctgtctgtcgtcgatggtgaagtccacccgcgcctgggcaagaaatccgtatggtttcgtgatctcagtctgatgaaacacaggatgaccggctgcgtggtgttcagcatcagcgaacagtatcgctacaccaacgatttcatcgtctacatcccccatgacccggaacatcccctcaaacgctacacctcagcgcagatgcgcgaagtattcaaacgcaagttcacggcgcgggacgctctgccctcgaatgaaccggcaacggcctatcaacgtttcttcagtcagtttgtcgcttatgccgaccgcccttattacttcagtcaattcacccggcctgcggcggatgcaccggtagacccgttacgttcgatctgggtaaaagtcgtccagatgttcccgccggtctcggttttcacgcagatcaaggaactgccgcccgagcaccagggcaagcgtgaaccagaggaggatccttatctcaatccgttcggtatcgtgcgcaacggcgtggcaggcatttgggccgccaataccgatctgtggcagtacctttttgaacagcattgcgacaaattcatcgccgatgcgcgtgcccgcgccgtaccgaccgcggatgtcgacgcgaacgtgcgggcgaaacggctcaatcacttgctggaattcggcatgctcgcgttgaacatggtgtcgatgttcgtaccggtgctgggcgagatcatgatgacggtgatggccgggcaattgctgtatgagtcgttcgagggcgctatcgaatggactgaaggtgatcgccaggcggccaagggacacttggtcgatgttgcagaaaacctcgcgctgatcggagtaatggcaggtgcaggcaagggcctgggcagattgactgcggccaaatcggtgccggtgatcgagaaggccgagcccattgaacgtctcgacggcaagccacgtttgtgggcacctgatcttgcgccttatgaaagcacagacgggccgtccgccgcgtctgtccctgatgcgcaaggcctgcatcgacttaatggcaagacctacattcgtcagcagggcaaggtgtatcaaacggcctttgatgaacaactgaaacaatggcgcattctccatccgactgacgcgtcagcctatcggcccattctcgaacacaaccggctgggcgcctggcgacataccttcgagcgaccgctgacctgggatcgattgacgctgctgcggcgtatcggccattgcaccgaggccttttccgatgagcaattgctcaacatcgcggatctcagcggtgtcagtgatgatgctctgcgccagatgcatctggaccattcgcctgcgccactggcgttggccgatacattgcgcctgttcgaggctgaccaggccgtgagccggatcatcgagaacattgaggacggttccaccgttgatgaacctttcctgctgacattgtcattgctgccacaaatgcctcgatggcccaccggacgcgtgcttgaggttttcgacggcccgggtttgtcaggcgcgagtgtcaagcatggtgacgcgtcactttttccaggtgacgctatcaaggcaccgattcagatcgcccgcgccgatgtgctgactgctcaaatgcccgccatccttcttgaggcgcttgacgagcaggaaatagtcggcctgctgggatctgaagcggcccgcatcagcgcaaaccggcccgtcgagttcagagcgcaattggtggacttcctgaaaacccgtcaaccgacaatgttcgagcagctctatgccgaaccgacattgcaggcaccgtggatcagccggctacaaaaggccacgcccgggctcggcagttctgcagcgatcagggtttgcatgcaggccaatgccgaagaacttgcgcgattggaaacaggcgggcggttgccgttgcggttgcttgaagagtcgcgcgggtacgctcaaggcaggcgcttcgatcatgcggtcgtcgggttacacatggagaacctggccgcatccgggagtcagtggctcgctttgcgcgtactcgaaagactgcctggctggtcagacgatgtgcgtctcgaagtccgcgagggcagcactcacggacccttgatcgatagtgtcggcagcgaatcttcgcggcaactgaaatacctggtcaagcaggggccctcctatcaggccttcaacgaacgcgcagaggagctcaatggcattgctcggcaaggcgataattttttttcttcggtcatgcatgccttgcccgacaaatcccgtcaggccttggggcttgctgacgtcagtcagagtgcatccctgcgtcgtctggtgattgatcacgtgcatcagtatcgcgctgaactggctcacttggccggcaagcgtcatggcgccggcaaacgcttcaaaccggcgctgcgagtgcccggtcatggcctcggttactacgccagtggacgcgggcagggcgtcaatccactgctggtgacacgggtgcagaatgtttatccgggcctcaccgatcaacaagcgggcggcttcattcttcagcagctggcgtcgggaaagactgacctgcagatctacgagcttctgcaaaggcgcatgcgtgaatggcaagagctcgactcgacactcgccgaatggcagggcgagtcgacgccagaactctcgctgcaatcgttgatcggtggcagagcgagcgtcgtgcgcaatatcaaacagagttggcgcgagtcaccgctggcgcaggaccatccgcgttatgcacagctggaattgatctgtgatgaaccgttaccagccttgactgcggacttttcgcatgtgcgtgagttgagcgtacgcggccgctgcatcacggatgcgaatgccgactcactgctggctgttttcccgaacctggaaaatttgcgcatcaatgcgacgagcgaactgttcagcaatgtgccgcaaatcttgcaggggatgccggcgttgaaaagtctgacgctttacagcgccgtcccgtttgccgctgacatgcctgcacggttgggcatgttggtccggattgaagaactgaccgtgtgttctgcaagctaccagccgatcacattcaacgtcagtcacctgcaaaagctgcgcaagctggagatcgtcgcctactccttgctggagtggccgaccggcgtgcttgaactgccggagctcgaacgactgagtctcaaggataccgggatcagtaacttgcctgaggggttgctcaaggggcacgaaaagttatggtccggattgtcactggactggtcgagattttcccgcgaaaacttcaaggtcgcctacgagtacgccaggacactgcccgcgcaccttatagaccgcgaagcgatggtccgcgattactgcaaaggcgagttgcagcgtttgggcgaaggcctgagccaggcggcgcaaagtatcttcgagcggtttttccagcaatggcctgatgaacaacagcgctacgccgcaatcgaagccctgagcgagcagtttgcaacgctcgacaaacagctcggcgagtggctgcaaaagggcatggcctatcaggaaacgctcagggaagtaatcgggcgatccaacgccatccatgccatcaggagcaattggcgcaaagggcttttcaagcgatacggttcgacggtttccgcttcgacccttgatttatcgggattgatgctaagcgagctgccgaaattgcctgccgatgcgttttctcatgtgcgtaccttgcttctgttgggccagcgcgtcgatgccttgcaactgcgcgatttcgtcagcgcctttcaagaagtgcaaacgctcgacctgagtgacaacgccctgcacgcgttgccgattgaacctggcagcctggcaaggctgaaccggctggacctttccgacaatctgttggtgaacactgagcagttgcagtcaagcctggaggcgttcccggcgcttgaacagctggacctgcataacaacccgttaactgggttgaacgtcggtggcttgtcgcgcttgaaagcgctcaatctgcgcaacgtcgatctgcaagcgtggcctgcgggcgctgaagatctggctcaactgacctggatggatgtgcgcaataacaacatcaccacgctgccacagaccctgctggacagccatgcgctgatcaacagcaatctgtccggtaatcctttgtcgccagcaacgacggttgcgctgcgagctgcgcaacagcgtatcgagtttgaaatcggactgcccgaaggtgcgctgcaagcatttgccgatgaaccggtcccgctgacctttccaccagcagagagcggactctccattgccaggcaattgctgccacttccccaggcggcagttggcgaaggtgaaacgctgatgatcaacattcttcagcgtatgcagccggcctttactgccgaacaggcgtcgcagttgattggccagatgcgcagtagcggagcgacggaggccgaaatagttgctcgtatcggcgcttggaaccagactttcgaaacgctggtgcggcgactcaatggctggctctacacccgcgaaattcgcggtgcggactgggttgtctcttcgcaaacccgcagtctggcggcctggagaattctcacctgttggcgggcaaggttgcccaacatggaaggtgtgacgcaagccgtgctgaacctgaacggtttgcaactgggagacataccggcattgccggaagattttgcgcatgtccgcacgctcaacctgacgggcacaagggtgactgtcgagggcgccaacggttttctcggtgcctttaccgagctacggactctggagcttggcggcaatgaactggaagcgttgccgcagtcgatccggaacatgtctgcgctggagcgtctggaactgtcgagcaaccgtctctacgatcccgaacgcttgtacgagtcgctttccgggcttgaacacctgacctggctggatgtgagctacaacaacctcgagtccttcgatgtcaactatttcgggcggctggaagctctcgatttgcgcaacaacaatctgtacgcatggccggaaggtgcgctggagtcggagcatctgcgcacgctcaatttgagccgtaacgacatcactacgctgcccgacgacgcacttgacggtagccacgaacaattgatgaacggtacagacttgactgacaactacaacttgtccgaagaaagcctcgtgcggctcagggcctatcaggcggaaggtgagcgccatcgggtgctgggtttttcacgcacggatctcgaagagatggttgacgacgccgccggcggcttgaccgaaacgtctgacagcattgaatccgacgaaaccctacctatcgatccgtcgcaggcgcaatacaaagccccatggcttgccaatctgcctcctgaacaactggcggctcgggatacgctctgggagcaactggctgctgaaccggacagcgcggcgttctttcatctgcttgagcgactgcaggacacccgagagttcagggtggccaacgcggatctgacgcggcgggtatggaccgtcatggaagcggccgcggctgataccgaactcagggaagtgattttcgccggggctaccacccacggaacctgcgtcgatggacgcatccttaccttcagcgggctggaaaccaaggtgttcacccataacgcgttgctggatttaccgtcaggtcgatcagacgcaaaaggtggggtgttgttgagtctgtcgcgacgactgtttcgcctggacaaagtcgacgaattggcaaaagcggcggcagcacgcagtggtttcgatgaggccgaagtgcgcctgggttatcgaatcggtttgactgccggctgggaggatggcctggagttgccggggcagccgaaaaacatgacctatgcttcgggcgtcagcccgcaacaactggtggaggtgcgaaccgaagtcagcaacgccgagcggtccgacaagtttctcgaagatctgattcagcgcgattactgggtggagtaccttcaggagaagttccccgaggacttcaggaaactggaagagtcacacttgcttgacgacggcaaagatgacggcctgagcgccgacgatcccgagtacttgagccggttgttcgaccgtacggccgaacgcaacgtgaagatgatcgagctttcgcagcaggagatcgacgcagtcaatgccgcaagaacacctgtatccggcgcttcaagtcatccatccagcgcatgaactgcatgcgccgctcccgacgccggttaaaccggcgccgggattgagccgagtgatcagttgtcgtaaccgaggttcggtgccagccagcgctcggttacgctcagctcctggcctttgcgcgaggtgtaactttgcacttgatccttgtcgaccttgcccacggcgaagtattgcgcttgcggatgggcgaagtaccagccactgactgctgcggccgggaacatcgcgtagtgctcggtgaggaacacaccgctgcgtcctgcgcgcatttcggcggcttcagggtcgagcagggtaaacagtgcggctttctcggtgtgatccgggcaggccggataacccggcgcagggcgaataccgctgtactgctctttgatcagcgcttcgttgtcgagggtttcgtccttggcgtaaccccagtgctctttgcgcacttgctggtgcaaccattcggcgcaagcctcggcgagacggtcggcgagggctttgaccatgatcgagttgtagtcgtcgccagcgtcctgataggccttggccacttcttcggcgccgatgccagcggtggtgatgaaaccaccgacgtagtcggtcacttcgctgtccttcggtgcaacgaagtcggccagcgagaagttcggcttgccgtcggtcttgatgatctgctggcgcaggtgatgcagttttgccaatggctggccatcatcgccgtacaactcgatatcgtcgtcatgcacctgattggccggccagaagccgaatacggcgcgggcgctgatcagcttctcgtcgatcaacttggcgagcatttcctgcgcgtctttgtacagcgaagtcgcggcttcaccgaccacttcgtcttcgaggatgcgcgggaatttgccggccaggtcccaggagatgaagaacggcgtccagtcgatgtattcagcgaggactttcaggtcgatgttgtccagaaccttgctgccggtgaatgtcggcttgaccggctggtaagacgcccagtcgaactgtggcttcttggcgatcgcggcggcatagctcaggcgttcggtgcgcgcgctgcggttcgaggtgcgttcgcgcacatcgacgtattccaggcgcgtcttctcgacgaaaccggccttcagttccttggacagcagctgtgtcgcgacgccgaccgcacgcgaggcgtcggtcacgtagaccaccgcatcgttgctgtacttcggctcgatcttcactgccgtgtgcgccttggaggtggtcgcgccaccaatcatcagcggcaggtggaaatcctgacgctgcatctcgcgagcaacatggaccatctcgtcaagggatggcgtgatcagaccggacaggccgatgatgtcgcacttctgctctttggccacttgcagaatcttctctgctggcaccatcacaccgaggtcgacgatgtcgtagccgttgcaaccgagcactacaccaacaatgttcttgccgatgtcgtgcacgtcgcctttcacggttgccatcagaatcttgcccttggcttccggtttgtcgcctttttccagttcgatgaacgggatcaagtgcgctacggcctgcttcatcacacgggcggatttcaccacttgcggcaggaacattttgccggcgccgaacaggtcaccgacgatgttcatgccggacatcagcgggccttcgatcacttcgatcgggcgggcgaacgactggcgcgactcttcggtgtcttcaacgatgtgcgtggtgatgcccttgaccagcgcatgctcaagacgcttgttgacctcccagctgcgccactcttcagtctcggcttccttgacgctgccgtcgcccttgtacttgtcggcgatggcgaggagggcgtcggtgccttccggggtgcggttgaggatcacgtcttcaacggcgtcgcgcagttcctgcgggatctggtcgtagatctccagttggccggcgttgacgatgcccatggtcagaccggcgcggatcgcgtacagcaggaacaccgagtggatcgcctcgcgcaccgggttgttgccacggaacgagaacgacacgttggacacgccgcccgaggtcagcgcatacggcagttcgtcgcggatgtaggcgcaggcgttgatgaagtcgaccgcgtagttgttgtgctcttcgataccggtggcgacggcgaagatgttcgggtcgaagatgatgtcttccggcgggaagccgacttcgttgaccagaatgtcgtaggagcgtttgcagatttctttcttgcgcgcttcggtgtcggcctggccggcttcgtcgaacgccatcaccaccactgcggcgccatagcgcttgcacagtttggcgtgatggatgaactgctcgacgccttctttcatgctgatcgagttgacgatgcctttaccttgaatgcacttgaggccggcttcgatcacttcccatttcgacgagtcgatcatgatcggtacgcgcgagatgtccggttcaccggcgatcagattgaggaaggtcaccatggccttcttcgaatcgagcatgccctcgtccatgttgatgtcgatcacctgcgcgccggcttcgacctgttgcagggcgacttccagggcttcggtgtagttgtcttcacggatcagacgggcgaatttcgccgagccggtgatgttggtgcgctcaccgacgttaacgaacagcgaactgcgatcaatggtgaacggctccagacccgacaggcggcaagccttggggatgtccggaatctgccgcggcgcataaccggcgacggctttggcgatggcttcgatgtgccccggcgtggtgccgcagcagccgccgacgatattgaggaaaccgctctgggcgaattcttcgatgaccttggcggtttccgacggcagttcgtcgtactcgccgaattcgttcggcagaccggcgttcgggtgcgcggaaacgtgggtgctggccttgttcgacagctcttccaggtacgggcgcagttcactggcgccgagggcgcagttcaaacctaccgagatcggcttggcgtgtgcaacggagttccagaacgcttcggtggtctggcccgacagggtgcggccggaggcatcggtgatggtgccggaaatcatgatcggcagttcgatgtgcagctcttcgaacacgccttgcacggcgaagatcgccgctttggcgttgagggtgtcgaaaatggtttcgatcaggatcaggtcggcgccgccctcgatcaggcctttggtggcttcggtgtagttttccaccagctcatcaaaggtgacgttgcggtagcccgggttgttgacgtccggcgacagcgagcaggtgcggctggtcgggccgagtacgccggcaacgaaacgcggcttggccgggttctcggcggtcttggcgtcggcaatcttgcgcgccagacgtgcgccttctacgtttaactcgtaggccagttcttccatgccgtaatcggccatggaaatacgcgtggcgttgaaggtgttggtttcgagaatgtcggcgccggcatccagataggcgttctcgatgccaccgatgacatcgggacgagtgatcaccaacaggtcgttgttgcccttgacgtcacttggccagtcagcaaagcgtttgccccgataatcctgctcttcgagcttgtagctctggatcatcgtgcccataccgccgtcgagtatcaggatgcgctctttgagagcttgcttgagagcttgaagacggacgctgcgatcggacatttggactactcggaaagaccattacgaaggagcgggatcataacaaacctgtgcggttttagagcatgtggcgcttttgcatgaatatcgctcatgttggtgcgggcgtcataatgtagaatcgcggcggttttttaaaaattcgggatcagcagcatgtcttaccgcgtcattggttttgtgttgctgtttctcagctggagcgccatggcgcaagagccagcggttgctcctgcaatttccccttctatttcgtacgtccgcgacatccagccaatcttcaccgagaagtgcgtggcctgccacgcctgctacgactccgcctgtcagctcaatctcggcagtggcgagggcgcagcccgtggtgcgagcaaaatgccggtgtatgacggcgagcgcactgtcgcggcgccgaccacccgattgttttacgacgccttcggcaagcgcgcctggcagcaaaaggacttctattcggtactcgacgcccaaggcagccaagcggcgttgatggcgcggatgctggaattggggcacaagacgccgctgacgcctaacgcgaaacttcccgaagacatcgtcttgggtctgaatcgggcaaaccagtgcgccatgcccgccgaattcgagggttacgccggggcgcacccgaaagaaggcatgccgctggcagtcactggcctgaccgatcagcaataccagaccttgcaacgctggctcgcctctggtgcgccgattgacgaacaaggcctggcgccgagcgcgaaagaatccctgcaaatcgtccagtgggaaaatctgttcaacagccccggtgcccgcgaaagcctggttggccgttggttgtacgaacacctgttcctcgcgcacctttatttcaaggacggcgagccggggcattacttccaatgggtgcgttcgcgcacgccgactggccagccgatcgacctgatcgccacccgccgcccgaacgacgatccgggtacgcaggtgtattaccgcttgtggccggtgcaaggggtgatcgtgcacaaaacccatatcacctacccgctgagcgcagcgaagatggcgcgggtcaaaagcctgttttacagcggcaactggcaggtcaacgccttgccgggctacggtccgcagagccgcgccaatccgttcgccacgtttgaagcgattccggcgcaggcgcgttatcagttcatgctcgataacgccgaatactttgtccgcacttttattcgtggacccgtgtgccgtgggcagatcgcgaccgacgtaatccgcgacaacttctgggcgctgttccaggcgccggaacacgacttgtacatcaccgatccgaactatcgtggccaggccacgccgttgctggcgatgccggggcagaacgacgacgtcggcagcgtgttgagcctgtggcacaactatcgcgacaaacgtaatgaatacgaggcgttgcgtcgcgacagctatgccgaagtccctgcgccaagttggtcgacgctgtgggcgggcaacgacaacgcgctgctgagcattttccgccactttgacagtgcttcggtgaccaagggcttgatcggcgaagtgccgcagacgatgtggttgttcgactatccgctgcttgaacgcacctattaccagttggcggtcaacttcgacgtgttcggtaacgtctcccaccaggcgcagactcgcctgtatttcgacttgatccgcaacggcgccgagcagaatttcctgcgcctgatgccggccgattcgcgcgaggactatctggacgattggtaccagaacagcggccagttcaagatgtggctcgattacgaagccatcgatgacgacaagccgactgcgctgaagctcgacgaaaaagacccgaaatacgacttcgccatgcaattgctggcgcgttacggcgacttgaatgcgcggccggatccgatcaatcgctgcgacggcgcttactgctcgcggccgaatatcgacccggcgttgcaaaatgccgaacaggccttgagtcgcctgacttcgcgcccggcggccggtttgaaggtgattgatcagttgccggaagcgacgatgctgcgcgtcgaaaccgccagcggcaaacgcgaggtttacagcctgctgcgcaatcgtgcacacagcaacgtggcgttcctgctcggtgagtcgctgcgctatcagcctggactggacacgatcaccattttcccgggcgtgctcagcagttatccgaacttcatcttcaacatccctgccgatcaggtgtctgaatttgtcgatgcaatggaaaacgccaaagatgccaaccgtttcgagaaaatcgtcgaacgctggggaattcgccgcagtcatccgcaattctggttctatttccacgatttgactcagtacatccacgaaaccgacccggtggaagagggcgtgctggacatgaaccgctacgagaatctttgatcgtttgcggcaggcttgctgtcccaacttcaagcgacaccgcaaaacccctgtaggagtgagcctgctcgcgatagcggagaataaggcactggagatgttgaatgtgccgccgccgtcgcgagcaggctcctcctacaagggatctgcggtggtttcaggacttgtgatcgggagcgggcaatgttgatttcagtgcaggccctgcgtgcgcttgccgcgtggacggtggtctgccatcacttcatgcagatcttcttcgactttcaggcgcgtgggcccatcgggcagctgttcatcgacaagggcgcggtgggcgtcgatatcttcttcgtcatcagcggtctggtgattttcctctcgaccgaaaacaaaccgctgccgccggcgcgctttctgctgtaccgcctgtttcgcattgtcccggcgtattggctgtacaccgtgctgatggcgctgctggtggtgttcgcccagccgctgttgccggatcagacggtggactggaaccatctgctgttgtcgttgctgttcattcccacggaaaaccccggcggctacggcttctatccgacgctgaatgtcggctggacgctgaattacgaaatcctgttttacctgctgtttgcctgggcgttgctgttccgcctgcaggtgcgcctgctgatagtcgcggcgttgctgtttgctgtaagtcaggcgtggaccgggtttggctggataagcgagttttaccgttcggacattgtctatgagtttctgctggggatcggcatcggcatgctctatcgccggggctggatcggtgcgggactgtggctgccactgacggccatcgtcgcggcgttgctggcgatttatcatttggcaccggcgccgaggctgctcaattggggtgtaccgagtgcggtgttggtgatggcgtgtatctcgcttgagcgttatgtcgagcgcagccgtgtgctcaagctgctcggtgattgttcgtattcggtgtatctgatgcatgttctggtgctgtcggcgggcggtttcatcgcgcgacgctatggcatcaacccgtatttgatgtttgtcgtgtgcgcgctggcgatcggcgtcggctcatggctgagctacgaatgggtagaaaaacgcagctatcgctggctcaaggcgcgaatcgacggcgcgcccgacgagaatctttcccgacaaaaatactaggactttgtccggcgcaacgattggcgtaaactgcgcccaagcctgcgaggagtttccatgaccgctattaccattaccgacgccgcccacgattacctggctgatctgctctccaagcagaacaccccgggcatcggcatccgcgtcttcatcacccagcctggcactcagtacgccgaaacctgcattgcctactgcaagccgggcgaagaaaaacctgaagacaccgcgctggggctgaaaagcttcaccgcttatattgatcacttcagcgaagcgtttctcgatgacgccgttgtcgattacgccaccgaccgcatgggtggtcagctgaccatcaaggcgccaaacgccaaagtaccgatggtcaacgccgacagcccggtcaacgagcgcatcaactattacctgcaaaccgaaatcaacccggggctggccagccacggtggccaggtcagcctgatcgatgtggttgaagacggcatcgccgtgctgcagttcggtggcggttgccagggctgcggccaggcggacgtgaccttgaaggaaggcatcgagcgtactttgcttgagcgcattccggagctgaaaggcgttcgtgacgtgaccgaccacacgcagaaagaaaacgcctactactaagtaaggtgttcactgcgaagccgtcacaaaccaggcaatgcattttcccgtgatgagtgcatttgtctggtgccacaagatcaaaagatcgcagccttcggcagctcctacattggaatgtgtttccctgtaggagctgccgaaggctgcgatcttttgctttcagggtctgtaaaggtgtgcatgccccgcgcggtacagcgatgactcgctaaacacctcactccctaatacccgcccgacgagaatcaacgccgtacgccgaaaccccttggcctcaaccttcccggcaatatccgccagcgtccccaccacccaatcctgatccggccacgtcgcccggtgaatcactgcaatcgggcaatcagcgccgtaatgcggcagcagttccgtcagaatcttgtccagatgattaacgcccaaatgaatcgccatggtcgcaccatgctgcgccagactgccgagttcctcacccgctggcatcgcggtcttatcggcataacgcgtcagaatcacgctttgtgaaatgtccggcagcgtcagctccgcgcccagcaacgccgcacacgcggccgtcgcggtcacgccagggatgatctcgaacggaatattcagctcgcgcagataacgaatctgctcaccaatcgcgccatacagactcggatcgccggaatgtacccgcgccacatcctgaccctttgcgtgggcggttttgatcagttcgatgatctgttccagatgcaattcggcgctgttgactaccgtgtcagcctgatgaccttcgagcaccgtcgccggtaccagcgagcctgcataaatgatcaccgggcaactgcggatcagccgctggcctttgacggtgatcagttccgggtcgccggggccggcgccgatgaagtagacggtcatcgtagaatcctgtgaaaaagaggcgcagcaatcgcttcagatgaagattgctcatgatcgatggcggggattatcgggtttttacgcggcgccggccaatgcgaaggtggcctgggcgtatttctgccgggaaatcagcagttttgccggtgcctgaatcaactgttcggcaagggccagcgcagcactttcagcaacgccgtagcaaccggtgcgttcgtaagcgatctcggaacggtggctgagtcgctcttggtaactggccaactcctcgctgctgaagtacagcaatggcagcgccagttgtgcggcgagttcctgtaaaccgggttcatcgcgtttcaggtcgatactggccaaagccttcaccgcatgaagctcaatgcgatgcgcctgtaacgcctgatccagtaacgcgcgcagcgtgctggccgggcagccgcgttggcagcccaggccgaccacgaaggtcggcgctgcgctgtcactcgtcatgcgtggtattgaccatcgattttgcggcggaacaaccaggcgctgatcaggcccagggccagccagaacactacgttggtcagctgcgaagcgattttgaactgcgcttccaatgcttcaggggcgagcatcgaatgcacttgcggctgaggcgcgccgatcacgtgcggcacggcaaggatcgccacgccgaggattttcatcaaccagtgccggctgaatgcgatcaacgacaggccgacagcggtcgacgcggcagtaccgatccaccacatctgtcgcgaggccagatcggctgcagcggtgcccggcaattcaggtggcaggcccagagtgggcgccagcacgaatgttgcgtaaccggccagcccccagagcaggccttgcgaagttttggtcggcgcgcgcagggtgtacagacccgcaagcatcagggcgaaacccacggccaccaccaggttgccgccagtggtcgaaaccacgcgctgccagccgtctgccggctcccaggcctcggtatcatgagtgtgcgcagcggtgccagcggcgtgttcgtggacttcggcaaccggttcggccttctcaaaggtttcggcctggagaatcagcggtgaaacccagaagctttgcagcagggtgaggagcagggcggccagcaggccagtgaaacctgcagtttgagcaattcgcttgatcatgtcggcaggtctcagtggcacgggaacgcggcgctgtggcgggtatcgtgcgcggcgttgtgcactgcttcgatatgcgagaaaccggcgaaatagaccaggctggcacccagaatcgacgcgaagacagcggcggtcaagcgttggctcaaggtggtggtgctggcgattttgtccgtgttgctgccggtgctgctgatgatcgacatggcgcttccctctggagtgtcagcgggtgattcagagcgcataaaacccctgcgggtcgagcacgcaggggttcgaacagcgcccgcccaccgcgggtttgttatgttcagcgacgcaaaatgcgtactgtgcgttgcgggccggtctccgggctcacgaggggttggcatctggcctacctgcaagcgtcaccttcccatgccgtactggcacagtggatctgacgcttcgctcgcttaccgttgcgggggcagcaccggactgacatgggcttgagtaaagcacatgattcaccggtttcccgtttcaccctgtgaagggcacccgtaacaaggtgtgtaggagagcatgggttggggattttagtcaatttgtggggtggatccgttgctgcgggtgttgctgattacggtttcgcccttacggcgactcagtttttttcaaacgccggaatgccggcccagcaaaaagtaagcaaaaaacgcttgctcctacgtgcggcccgctcgctggggctcggggttccatcgctccgggattgatccgggcgcagcgcctacggtttgctgcgctgcacctcctctcgctgtgtttggctgcgccaaacggtcgctgcgctcccacgcccggatcaatccctccactcagccttccgacgtcgcccgtggatcaagatcaagagcaggcgagctgacactcggcctattgagtggtgaagagcggggtgtggtcggctttggatttgtggtggtgcttcccctcatcggaacgccgcccgcccagccctctcccgagggagagggggccgatttgtgggcgtttcagaacctgagttcaattcggtatttcacgtcggcgtagctctcccaaacaccccgatcattcctcctaacctcatggatagggggccggtttttttgcttttttgagcccgagttcaacgcgatatctcacgtcggcgtaactcccccaaacaccgcaatcagttccctctccctctgggagagggctagggtgaggggcttgtgatcttgctttggctttggtttttgatcttttgccccttcggcaggccgagcgtaggtgttcatccgggggtaggcgcgcagcgccgtgcggcgtagccgcatacatcgagaggaggtgcagcgaagcaaaccgtaggcgatgcccccggatggacaccgtagcgagggaacactgagcctcagcgaagtgccgtacgccggggcaaagccttttggttcctttttggcgtttgaaaaagggactcgctgtaagagcgaaaccgccagcggcagcacccacagcaacggatatgccccaaaaaccaaaactcaacgcccattgacccacccttagacgatgcgtagccttgcgctttcgaggttcttcggccgctgccgaagctaagaagggaacgcggtcaatgccgcggctgcccccgcaactgtgaacggcgatgttcgctgccacgccactgccagctcaaccgatgagcccgcgggaaggcgcagcaaacgccaggcccaccgcctgaacgccgtcagccaggagacctgcctcgtcacagattctcactacaaccgggcggggtgatccggtggcgaactctccaggcatgcgcgtgcgttgccggttctcgtcccgtatgcccgccgcttgccaaagggcataccgatgaaaacactggccaaactccccgtcactatcgtcaccggctttctcggctcgggcaaaaccacgctgctgcgccatatgctcgacaacgcccagggccgtcgcatcgcggtgatcgtcaacgagttcggcgagttgggcatcgacggtgaaatcctcaagcaatgcaccatcggttgcaccgaagaagaagccaccggtcgcgtttacgaactggccaacggctgcctgtgctgcaccgttcaggaagaattcttcccggtgatgcgcgaactggtcgcacgtcgcggcgatctcgaccacatcctcatcgaaacctcgggcctggccttgccgaaaccgctggtgcaagcctttcagtggccggaaatccgcagcgcctgcaccgttgacgcggtgatcaccgtggtcgacagtccggccgtagccgctggcaccttcgccgcgttcccggatcaggtcgacgcccagcgcaaactcgatccgaacctcgatcacgagtcgccactgcacgaactgttcgccgaccaactggccagcgccgacctcgtcattctcaacaaggccgaccagaccagcccggaagacctcgctcgtgtacgtgccgaggtcgccgaagagttgccgccagcggtgaaaatcatcgaagccagcaacggtcgtctgccgctggacgtgctcatcggccttggcgccggttccgaagagcacatcgacagccgccacagccatcacgaccatcatcacggtgaaggcgatgacgaccacgatgaccacgatcacgacgctttcgattcaatctccatcgaactgccgcaagccgatgaaagcctgctgctcgacgccctgacgcaactggtggtcaagcacggcatcctccgtgtcaaaggtttcgccgctatcccgaacaagccaatgcgcttgctgatccaaggcgtgggcacgcgtttcgacaagcatttcgaccgccagtggggcgctgatgaagcgcgcgtcacgcgcctggttttgatcggccagcaactcgacgccgcgcaactcgaagcgcaattgcgcgccgcgctcagcgtttaaatcatgcacctgctcaggactcagcccggcggattcgtctcggatgacaacattgccgaccttggccaaacccccgccgagctggtgatcctgtgcagcggcgactccagcctggcgctgctcgccgaagccgcgcagcagttgccggaagattacccgagcctgcgtctggccaacccgatgcaggtgcagaatcacgcgtcggtcgatctgtacgtcgatgaagtgctgcgccacgccaaagtgattctgatctcgttgcacggcggcatcgcctattggcgttatggtgtcgagcgtttggttgaactgagcgagcgtggcgtgcaggtgattctggtgccgggcgatgatcggcccgatccggaactcagcgacttgagcaccgtcaacgcagaggatcgcgaccggctctggcagtttttgcgtcagggcggcatgggcaatgcgctggatttcttccgttgcatggccagccgttggctcggccgcgattacgtctgggaagaaccgcaaaccctgccgcgcacggcgatttaccacccgactaaaaacaccgctgcactgagtgactggcaagcccaatggctgcctgagcaaccggttgcggcggtgttgttttaccgctcgcatttgcaagcggcgaacaccgcgttcatcgatgttttctgccagcgcttgcaggtggcgggacttaatccgttgccgatcgcggtggccagtttgaaagaacccggctgcctggcggtggtcgaggattggctggatgaagtcgacgcgggggtgatcctcaacaccaccggtttcgcccagtccagccccgaagcgccgcacctgcggccgtttcgccgcaacattccggttattcaggcgatctgcgcgcaagacaacgagcccggctggcgcgacagcgagcagggtctgggcccgcgcgatctggccatgcacattgccttgccggaactcgacgggcgcatcatcagccggccgatcagcttcaaggatctggcctggcgcagcgagcgcagtcagtccgatgtggtctgctatcgcgcgcagcctgagcgcatggattttgtcgctgaactggcgcggcgctggatcgatctggcgcgggtgccgaatggcgaaaaacgcatcgcgttgattctcgctaactacccgacccgcgatgggcgcatcggtaacggcgtcggtctcgacacgccggcggcagcgctgaacatcctgcgagcattgcaagccgagggctatccgatcacggcagagttgccggacagtggcaccgagttgatccagcaattgctcggtggcgtcagcaacgatctcgacacattggacctgcgcccgtgccagcaaagtctggcgatggacgcttatttggccatgttcaatgcgctgcccgaagccaatcgcactgccgtgattgagcgttggggatcgccgcaaaacgatccgatgtgccgcgacgggcggatgatggtcgccggtctgcgcttcggtctgaccttcgtcggcattcaaccggcgcgtggttatcaggtcgatccgagcgcggtctatcacgatccggatctggtgccgccacacggctatctggcgttctatttctggttgcgcaacacctacggcgcgcacggcgttattcacgtcggcaagcacggcaatctcgagtggctgccgggcaaaggcgtcggcctctcggagaattgctggccggatgcactgctcgggccgctgccgaatatctatccgttcatcgtcaacgacccgggcgagggcgctcaggccaaacgacgcacgcaagcggtgatcatcgatcacttgatgccgccgctgacccgcgccgaaacctacgggccgttgcgcaatctggagctgttggccgacgaatattacgaggcgcaactgctcgatccgcgccgtgctcgtgagttgcagcgcgacatcctgcaactggtgcgcgacacgcagattgatcgtgaactgcaactggatgcgggcctggacagcgacgccgatgcggcgatctggctgccgcgtctggacacgtatttgtgtgatctgaaggaatcgcagattcgcgatggtctgcacatttttggcgagtcaccgacggggcgactgcgcattgatacgttgttggccttgctgcggattccgcgaggcgatggaaaaggcgcgcaatcgagcctgctgcgggcattggccaaggcgtttgaactgggtttcgatccgctcgactgcgggttggccgagccatggaccggcccgtgccccgaagcgctgcaattgcaaagcaacgaatcctggcgcaccgccggcgacacccgcgaacgcctcgaactgttcgccactcaactgatctcccagacactgcaatccccttgtaggagtgagcctgctcgcgatagcggagtgtcagtcgctgaagatttacctgatccaccgctatcgcgagcaggctcactcctgcagggaccgcgttgggcggaggtcagtgcaatcattcagaatctgcgcgaagtcgtcgccccacgcctggacgcctgcggcccggcagaaatgcgcggtctgctcgacgccctcggcggtcgttttgtccccgccggccccagcggcgcaccgagtcgtggccgcctcgacgtcctgcccaccgggcgcaacttctactcggtcgacgtgcgcaacctgccgactacgacggcgtggcgcatcggtttccagtcggccacgctgattctcgaacggcacttgcaggatcacggcgatcacctgcgtcaactcgggctgtctgtctgggggacggcgaccatgcgcaccggcggcgacgacatcgcccaggccatggccctgatgggcgtacgtccggtatgggcgacaggcagtcagcgcgtcgatgacttcgagattttgccgctgagtctgctcgaccgtccgcgtgtcgatgtgaccttgcgtgtctcgggattcttccgcgacgccttcgccaacctgattcgcctgttcgatgccgccgtgcaagccgtggcagcgctggacgagccggacgatctcaatccactcgccgccaaagtacgtgccgaacgcgaggcgctgctgcaatcgggtctcgatgaagacaccgcgcggcgtcaggccggatggcgaatcttcggcgccaaacccggcgcttacggggccggcgtgcagggcgcgatcgacgggcgcctgtggcaaacccgcgaggatctcgccgaggtctatctgaactggggcgcttacgcctatggcggttcggatgaaggcacggctgcccgcgagcaattcgtccagcgcctgagccaagtgcaagcagtgctgcagaatcaggataaccgcgagcacgacttgctcgattccaacgactattaccagttccagggcggcatgctggctgccgtcgaaagcctgcgcggcgaagcagcggccagttatcacggtgatcacagccagccggatctgccgaagattcgcaccttgaaagaagagctgaaccgcgtgatccgctcgcgggcagccaatccgaaatggatcgatggcgtcaaacgccacggctataaaggcgcgttcgaaatggcggcgacggtcgataacctgtttgcgtttgatgcgaccacgcagttgatcgacgatcatcaatacgcgctgctcgccgatgcttatctgctggatccggcgacccgggaatttgttcgtgagcataatccgcacgcgctgcgcgatatgaccgaacggatgctggaagcgcagcagcgcgggatgtggcaggaaccgggggcttataaagaggcgctggagaatctgctgttggatattgaggaagatatgtagcgtcctcaggaaagtcaccccctcaccccagccctctcccccaagggggcgagggggaaagggagccgatttgtgtgctgttcagaatcgaagtcaactcgataactcaggtcggcgcaacttgcaaaagcaactcggtcagttccctctccctctgggagagggctagggtgagggctaccccaactgacaccccacaacactcaagcacacccacgaccacgacagagaaaacccaaatgaccgacaccccgcatttcccgctctccgccgtggtcggcgccgatgacctgaaactcgctctgtgcctcaccgccatcgacccgaaaatcggcggtgtgctgatcgaaggtccgcgcggcatggccaaatcaacgttggcccgaggcctggccgatctgcttgccagcggccagttcgtcaccttgccgttgggcgccaccgaagagcgcctggtcggcacgctggacctcgatgccgcactgagcgaaggtcgcgcgcagttttctcccggtgtgctggccaaggcggacggcggcgtgctctacgtcgacgaggtcaatctgctggccgatcacttggtcgatctgctgctcgacgtcgccgccagcggcaccaacctgatcgagcgtgacggtatttcccatcggcactcggcgaagttcgtcctcatcggcacgatgaacccggaagaaggcgaattgcgcccgcaattgctcgaccgcttcggtctgaacgttgccctcagcggccacaccgcgcccatcgagcggggccagatcatccggcgtcgactcgatttcgacagcgatccgcaaggcttctgtgcgcaatggcaaggcgaacaacaagccttgcgcactcgttgtgaacacgctcgcgcggccttggccaacattgcgctggacgatactgcgttggcacaaatcaccgaacgttgtttcgctgccggggtggatggcctgcgcgctgatctggtttggctgcgtgcggcccgtgcccacgcggcatggcgcggggcagcggagattggcgaagaagacatcgacgccgttgccgagtttgccctgcgccatcgtcgtcgtgagcaaccgccatcggctccgcaacagtctgcacagtcgccggccgagactcaggccacaaagccgagcgaagggcagggcgagtggggcgacatgcctgcgcccgccttagccactggcgcccgccgcgaagtgccgagctggccgctaccaaaaaagccgtaagcattcgcccccgatccgcagcgggggcgaatgccaaaccccgggccggacaactggacggtggacgtcagggcaagcgccatgtggcccgcagcggtacggtgaactggccgggcaccttgctcaatgggcgtcctcgagtgcgtgaagatctgctgttccaattgcgcacgcgttcgccccatgaactgtggctggtgatcgtcgatgcgtcggcttcgactcgtcgtcatcatgccttgagggacgccaagggcttgctcgcgcagttgttcgatgacgcctatcggcagcgtgcgcggctggcattgttgaccgccagtggcaccacgccgaaatggcaggtgcagggtttgaaagcgtccagcggactgggcgtctggcttgatcagttaggcgcgggtggcggtacaccgttgctggcggcgctggcgcaggcacagcaatggttgacggttcggcgcaagcgctttcctgccgagcaacagcgattgctggtggtcaccgatgggcgcttgaaggatctcggtgcgatgtcggcagtagcctgtccggggctgttgatcgacattgagcgcgggccgattcgactagggcgggccaaggaactggcggcggcgctcgaggcggattatcggcatatcgacgaactttgaaggttgcggtgtctgagcgggcctcttcgcgggcaagcccgctcccacagggtttgatgtcaaaccaagcatcacattcacatctgagacttctgtgaaagcgagcctgctcgcgaagcttttcagcttgctacagattttgaaatgatttgccgctgtaggaaatgttcccaaagcctgtacgctccaaggccatttttcattcaggatttgcatgaacaccctcttggaacctcccagttgtagttcccccacgcgccattgcgcggtcttgacgcactcgcagcatccggttttccgacacccgactatcgttgttaacgcggctcttgagccttcgcgttgcgctttgccgtgtccggcagcctgaattcactgaagagagatcgagacgttttatggaatggttagcggatcccacggcctggttaggcctgttgactctgatcgtgctggaactggtgctgggtatcgacaacctggtgttcatcgcaatcctcgcggacaaactgccaccgcatcaacgtgaccgcgcgcggatcatcggcctgtcgttggcactgatcatgcgtctgggcctgttggcgagcatttcctggctggtcaccctcacgcagccgttgtttgaagtcttcgacaagagcttctccggccgtgacctgatcatgctgttcggtggtgtgttcctgttgttcaaagcaacgatggaattgcacgaacgcctggagggtcacgttggcgagcggtcgacgaataccgcgtatgccttgttctggccgatcgtcgcgcagatcgtggtgcttgatgcggtgttctcgctcgacgcggtgattaccgccgtgggcatggtcgatgaactcgcggtgatgatgatcgcggtgatcatttccattggcctgatgatcgttgccagcaaaccgttgacgcgcttcgtcaacgcccacccgacggtgatcatgctgtgtctgggcttcttgatgatgatcggttttgccctgaccgctgaaggtttgggcttccacatcccgaaaggttatctgtacgcggccatcggtttctcgatcctgatcgaggtgttcaaccagattgcccgcgcccgacgcaagcgttcgatgcagggcctgcgcccgatgcgcgagcgcacggcccacgcggtcatgcgcttgctcggtgggcgcaagttggcggtggaagaggttggcgaggagatttccgacctgctggatgatggcgaggcaccgactgccgagctgtttgatcgccgcgaacgagtgatgatcagtggcgtgctgcaactggcggagcgcccgatccgcgccctgatgaccgtgcgcgccgatgtcgacagcatcgatctggctgatgacgcggaggcgattcgtacgaagttgatgcattcgtcctactcgcgcctgccgttgattcgtgacggtgcggtggatgaacccttgggtttcgtgcacaagaaagaattgctcaaggaatacttggccggtaatgaaccgaatctggagcatttggcccgcaagaccgtcaatctgctcgacagctactcgattctgaacgcgctggagcaaatgcgcggtgcgtcgacgcacatcgccttcgtggtcaatgaattcggtgattttgtcggtgtgttgaccatgaccgacatccttgaatcgattgccggtgagctacccgatgccagtgaaatcgaaggcccggacgtcgtcgaagagcagggcggatttatggtcagcggtgcattgaacctgacgcgggttcgccagcgcaccggttttggcgctgagccgaccgaggattaccagaccatggccgggttggtgatgagcctgctggaccgcttgccgatgaaaggtgattgtctgacgcatgaaggttggcaaatgaccgttctggcggttgaggagcggcgggtgacgcgggtgttgttggttcccgaggccgcgtaataccgaagccagctaaatctactgatgaaaagtgtaccgatccttgccggtatgctttgactcatacagtgccgcatccgccttgatcagcgcctggttcaacgtgtcgttgtcctccacgcaggtcaagccgatgctgatggtcactgggtgccgtgtgggttgctcgcgcaccaatcggcacagttcggtcgcgagggcttcaacgtcttcgcgccgcacgccggccagataaatcgcaaactcttcaccgcccagccgggcgtaatcgaacggcagcatgacggttttgatatcggcggcaatgcgcttcaacacctcatcgccgatgtcgtggccataggtgtcattcactttcttgaagttgtcgatgtcgatcattgccaggtaatggtcatgctcacgaggcacggcgtgcagatgttgttcggcgacggtcatgaatgagcgacggttggggatttccgtgagggggtcgttataggcctgatccagcagcagcctggacatgatgtagttgtagagcttggcttcgcgcaatttcagaaaggtgtagatggtcagtgcgcagagaaacacgctgtagcacgcggtcagtacacccctcaattcgatcaggctgatagtggtattgatgaaggggttgagcagtacccagatcagcacctgaacgacaaagaatgaccagcgactcagcggcagcaccgagatgctgtagagcatgctggcggccgcgagcaccagccaggaactgtgtacggcgggtggcagaccgttgacgataaaacgtatgccaacggtcagtcccagcacgaacagcacggtgatgacattgaagtggcgagccttgcgggtgaaggccagcaccacggtcaacaccgcaaacagcgccaggaaaatcatcgagcgccaagtgaatccctgaccgccgaggaaacttacgatcaggtcgaataacagccacatgccaatgctgacgatgtagatcagcaggctgaacgactgcatgcgctcgaattcatgctggatgaactccgcccgcaattcggcgggcgcagttttcttcagtacctgctcttcaatggttttgtacattgccgccctgatggttgcgctggttgtcgagaatcactcggccccatggacgatagcgcagtgaaaacactgcgccgggatgacacccggtcgatgtcgcatccggggcgacgggttcggcgtggaagggctggccttcacggctgacctgacgaaacgcttcacgcacaatgccgacggagcagggcagcgcgctggcataaccgtcacgcacgaccaccggcaagcgacctgtgccggcgccgtcctgccaccacacctgaatgcccattgcgctcaaatcgcccagccactgcccgtttaccgttggggccagtttgccggcactgaatgcgctgacatgcagcggcgcatcgatttttgcggcgaaatccttgagctgcttttgcagcgtcatacgacggtccgccgcgagaaagtggaagtcatccagctccagcggcaagtaccagccttgtaccgtgagtttccagtcttcgcgcagtcggcgctgctgagccagcgactgacccaattgcgcttgccaatatttgccgagggcggcgctgtccagttcgtcgatgcgttggtaataggccgggtccatcttcaatcccaacaccaattgcaaaccttgctgttgggcgagcttgaggctgttggcgagccagccgttggcgccgccgaaattggagtcgccataggcggtccattgcacaatcagggttcgcgcgccctgtctggcggtgtcctgccagattttctgccactgcgcctgactgaggctggcatcgacattcagcggttgatagaacacacgctcatcggctcgtgcgaagagtgagccaaacatcaggcagaaacacagcatccagcgcgccatcagaaattccactccacgcccagcagcacaccgttgccaccttcatacagattgccgcccagggactgttgatattcggtgcgcaccgtcagtttagaacggtaggcgttgtagcgatcatcgtcgtaccaccactgccatcgcaggccgacaccggtgcgcaggtcttgccgccaatcgttgctcggatcctggctggcgaactcgaggaaaccatacggcatgatggtctgcgcgccatttaacggcagcttccaggtatgaccttgctggaaacgggacagccattggtgatcgccagccttggtccaccatgcagcgtcgaggtagaggaagcgctcatcccattcgctttcgtcaacgcgccagtcgttgcggtatttgccctgatcgaggaacgacgcggtggcgcgcagcaggtagtcggtagtggtgtggccgtcctggcggtggtcatcgagttggtccgagagtttgtcgggattgatcaactggccgaggctcaggccgtggttgtccttgtcgtcgaactggctttgcttgtagatctcgccgtagaagttgatgttttgcgtaccccacggcttgtaacgcaagcccacgcctgccgccacggattcggcgtagcgggtgcggctttgcccgccgagcaacacgcgaccataaaccgaaagcgagctgccggcgcggcttggttcctcacccagagcgtgatcccacatcgcaacctggacgttttgcgagttggggctgcgatttgaaccctggctgtcgtcgtcacgcagaaagtcgttagtcgatacgccggcgggtgaccaggtactggcgatagtaaaattgtcgcgccgggacagcgcttcatgggcgcggcgctgacgataacgccgggcctccatgctgccgtcctcatcgtcggcggccaccgggttctgttccagatcgataacccgacgcagctctttacgtgccgaggcactgtcctcgatttcgtcgtaacgccaggccagggtttcgccaaggtgatagtcctcgggaaaatcgcgggtcgcctgttgcagataggggatggccgttgcgcgttcttcgcggcttggcgcaccggacagacgcatgccgtagtcggcgcgataacgcggattggctggatcgcggcgcaccgcttcggcaagccaggcattgctttgcgccaggtcgccagccttttgcgcggaaaccgaagcggcataaaaatgcccggcgtccggagcgatttgcaaggctcggcgttgccgttgcagcgcctcggcatgatcgccgcgagcgtcggcgatggccgcgccaagcgaccattcattggcgccgcgagtgctgctttgttgccagaagcgctcggccgcttgattgtcaccggcattcaatgcacttcggcttgcagtcaggcgtgcattgtcggtgagttcggcggccggaatgctgcgccagatggccagtgcgccggtggagtcgcccgccgcctccagcgcataggccaacggcaagcgactgctgcgatcgcccagtttttctgcctgctggtaatacaccacggcctcgccgggacgatcaggcatcgcacagcgggcgagggcgcgatagtcgccagccgcttgcgggtgactgccgatggcttgttggaccgcatcgcattgcccggtttcggcgagttgtgcgagcagttggccacgggtagcaccgtcgatatgactgatcaaagaggccatacgccgttgttgcgcgggcgtgatgtctttcgacgacgcgtaaagccccgccaaacgctgcagagctacaggcggcaggcgcgcgccgtgacggtcgtaagcattttccagcagttgccgggcgtgggcgcgatcaccgctttgcagtgcgagaaaactggcctgattcagtgacgccaggttgccggtttgccgatagtggtattcccacagcgtttgctcttccgtacggcgccccatgcgttgggccagttcggccctgcgcttgaccaccgccggggtctgcgtctggcccgcgagccagaccatgactttgctgctctcgccctgttcctgccagacatcgaccagttgcgcctggcgacgactgtcccacggctcgggcaaacgcgtgctctgcagcaagtccgtcgcttgcaggcgctgagcgaggaccagccaggcttgcggatcctctgatggctggcactggcgtagttgcgtcaaagcggcttcggggtcatggcgcgatagccactcggtggtttccaggcacggacgctgtaaatcgttgctcagacgttgcacggtggggacgtcgtcggtttgccgcgccagttcccacaggcgctggcgttgcgccgggtcggccaggtcggcggcgggcagggattgcagccagcgctgcgcctgttggtcgtggcccatggcgatggcgtgatcgaccatcgccagacgcaccttgcgcgccgcttgcgggtcaggtgcctgctgcaacagctgttgcaagggtttttcatcgagacgttgcacgtaggcattggccagccgctgccagccttcggcgtccagctgtttgcgggccgcaagcggcgccagttcgccgatggtgccgctccagtcgcgcaattgttccgaccagttggcgcgggccagacgcagaatgttttcatcgcccttgggcgaaagttgcgccagccagtcgtgggccttggccgcaccgccgaacttggccaggctcaagctgtaagcctgccaaagccgtacgcggtcgttgaggtcgctggtggccatccattgttcgacttgcgtgctgctcggcggatcctgctcgatccaggtcagacgcaagtcgagcactgcttcactgttgtcctttggcaatgcctgaatcgcatccttgtagcgacgctgtttggccaatgactcgacgagcaaggcccttgcctcatcgtttttcggcaccttctccagcaagtgccgcatcaagcgttcaacttctttccagttgccctttttcgcctcgcgatagctgcgatccatgtagggatagctgcgaaactgctcgaaatcactcagcggtgcggcttgcaatgggtacgctgtgctcaggccgagcaacaggctgcccagcaacagggtgtgacgctgaacaggcctcatgcgacctcccggacgatgcggtaggcggcttgttgttcgctggcctggtcggccagtgcctgatcgagtacgtcctgggtgatcatgccccgggagatcaggtgttcgccgagcgacatcttctcggcgtcgaaatcgatcaacgcctgattgaacagggtggggggcaccatcccgcgtacctgcagcaaattgcccagcaacacctgatggcggctgacgcgttccagcaaggcttcatcgtcctggtgacgctccagcacttcaagcatatgacgcacttgcgcattctgacgggggctcgcgtaccagtgacgaatccccaaagtcacccggccctgcggtgccagtcggcagcgtaccgggcgtttcaattgacggctgatcgcgccgagcgacacctgactgaccgggccttccgacgccagcaccagtgtttcgccatcttcagcgaccggcagcacgccatagtgcgaggccacgcggcgcggcacggcatcaatcaggcgtttgtcgagtttgaatggattgagcggcgcccactccaggtcgagttgttcggccagcgcctgcaccagttgcgtactgtcgatgtactcgcgcaacaacaattctcgtcccaggcgtcgacgtaccggactggtgatcgccgcttccagttgttcctcggtcagcaagcctttttccaccagacgatggcccagcggtgtgcgttgggctttggtcagggcggggaactcatgggtggtcttgtcccacgccacgcggcgggagtcgcccatttccataacctgtttaagcgcgcgcagattggcgaagaagttcacgaagttgctccacatcattcgtggtgccgacagcaggccctcgcccagtccgtaataacgggtgacgaaccagccgcgctggaacaggcggttgagcagcatgaagccgttcagccagagcagcacgggcaggatggaactgtcggagagaatcgacgggtaacgccacgactctggggaaaccaccgtcaccagccacatgacgatcaatacaacaaacagcaggttgaccagaaaactcagcatgtaggcaatcaggccgcgtcggtcgcgccagaggaaatagttgagcaggcccttgcggctccagccaaggttcttggtgccctgaaacacgatgccgacgatccagcgcgatttctgccggatcgcgtgctgcaaatcccgaggaaaatgttcacggacacagatcacctgggagaactcgcggttcatgccgaacacccacggttgctccagcgccagtttcggattgctgaccgagtagcgggcgaaaatgcacttcatgcctttctgcttgaggcggaagccgatgtcgtagtcttcggtgagactctgtacatcgaaagcgataccgtcgccgtcttcgagcagggcgctgatggccttgcggctgaagcaggtgccgacgccggcgctgggcacctgaccggtcaaggcctcgcggacgatgacgtccttgccgtggttctcggcgaactcatcgacatagtgaccggcagtgaagcctttccattccggtgcataggggtagaccgggatctggatcaggtccttgttaggcagaagatagttgtacagacgcaattccatcggcgaaatcacgtcttcggcgtcgtgcaggatgaacccggcgaactggatttttgcctcgctttcaaagcgcaggatcgcgtcgatgatgttgttcaggcagtcggccttgctggtcgggccagggcgggcgcagaccactttgtgcacgttggggtaatgctggcaaaccgcatcgacgtcggcttgagtttcgccgtcgttggggtaggtgccgacaaaaatctgatagttctcatagtcgatggtcgaggcagcaaggcgcgccatttcgccgaccacaccgacttcattccatgccgggaccatgatcgccagcggtttttccgggatcgcgtacagacgctcctcatcggcgcgctcgaatttttcgtagattcgccagcgccggatcagcctgcggccccagtacacaaggtcgatgaacaggtcatccagacccaggatgaacatcaacaaggcgaggacaatcgccacatatttgagagcaaacaacacatacgcaaagaaatcgacccaacccagactcataccccgttacccgccgccgagcgtgcgctcaaccaggcgtgcaggcgggaggcaatcaattcgctggcgtgaccatcgccataagggaaatgcacacggctcatgcgcgtataggtctcttcgtcgtcgagcagttgcgcggcttccttgatgatgcgggccttgtcggtgccgaccagcagcatggtgccgctttccagcaccgagggccgttcggtgacgtcgcgcaacaccagcagcggtttgccgatggcgggggcttcttcctgcacgccgccggagtcggtgaggatgaagtgcgcacggcccatgagccagacgaaattcggataatcctgtggtgcgaccagatagatgttgggtttgttggcgagcatgccgtacaccacctcctgcaccagcggattgaggtgtaccggataaacgaattgcacgtccgggtaacgctcggcgagttctgccaaggcctgacaaatattctgaaaaccatcgccgaggttttcccgacgatggctggtgaccagaatcatcctgcgctgatcatcaagcactgccaaaggtgaatcagctgctggctgccaatcggtttgttgctggtgggcacgcatccacaacaaggcatcgatcaccgtgttgccggtgatttcgatgttgtcttcgggcacgccttcgcgcagcagattggcggcggatttcgatgtcggtgggaagtgcaggtcggcgatgacgccggtcaggcgtcgattggcctcttcaggccacggtgcgcgcagattgccggtgcgcaggccggcttcaacgtggccgatgggcagttgccgattgaacgcggcgagggcggcgatgaagctggtggtggtgtcaccgtggaccagcacgatgtccggtttgacccgttcgtaggcctgatcaagctgtgccagcaaatgctgcgacaaaccgttgagggtctggccctgggtcatcacgtgcaggtcttcatccaccgtcagctcgaaggcgtccagcacctgagtgagcatctcgcgatgctggccggtggagcagatgttcagttggatgtcaggccagtgacgcagaacccgagcgagcggggccattttgatggcctccgggcgagtaccgaaaaccatcatgactttaaaagacattgaccccctcctggactttgcaacgctggggcgaaacgcctttcgcgtgttctcttactgagaaataaagaaaagcagccggatgggagcttgtccaatcaggtttggggcttgtttgttaccgatgatttaggaagaaagtgccatcagttgatggctttttggatggcaacttcaggaaaagtcccatcggcttgcgcgtgggatcgtacagagggtgcgcagggtctgccgaagccaggtcagatcatgcgagggtttgcggggggcggagggggctttggtcctgccgatatgctcggcgaaatcccgtgcaagcgtttcttcggtgccgatgcctttgagctttttcaccagcctgccgttcttgtagaacagcactgtcggcgtgccggtcacttgcggatggcggggcgactcgctggtgttgagcatataaatgtcggcgcgctgccggtacggctcggctgtctgacgaaagatcggcccggcccattcgcaggccgggcagtgttcgttggcgaaatacagaatcactgggcgccaggttttcagggctttgcaataaaccggagccagatcggtattcgatgcgatggctttcattgaaatctccttttcaatgaccttgtaggttcaatgacgttaaaggagagggggcaacaaggtctactgtcagaaattacaggtgcgcgtaaaaaccgtgagttttttcccacgaatttacgagagctacccgacgagcaagacagaaacgtcggaaaagaacgcatgatatcttcattcgcattggagtcatgactcgtttggagtgctattttgggtgccactaaaagccccttaaggagtaccgtcatggcatacatcattctttctcacgtagttgcgagtatttccgaattgaaaaaaaaaccgatgggaaccgtcgccgccgggggtgggcagtcagtcgcgattctcaaccgaaatgagccagcgttttactgtgtacccgccaaagagtacgagacgatgatggcgcgcctggaggacctggagttgatagcgctctgcaaggagcgggaaaatgacccgactatcaaggtctcgatagatgacttatgagctggagtgtcaaggatgaaatcttgatcgtcaccgtgatagctgtcggtaaacgggaacggggcgatggttataaagaagcggccaaacgctgaattgcttttaagagctgaatccatgtttctatggtttgcaccgaaccggatcacccaagccccaaatgggaacctcctactcgcggtgtgtagcccacagtagcgcgttcaatccaagttgcgtctcgcgataacttccctgcttgctgcatcccattgattccagaaacatttcaatccattgcagattcagactgaatcctgtggcacactttctgctgtctattccgtagtaacaaaccgtgttccggtatagcggaataaacacaaatctggagtgcttgccatgcatcgccgtccttcgttgttcaaagcgtgtgtttttgttttcgcggcttcgtccgctgtcatgggtatggcccaggcagccgacggcaagctcgacagtgttctggcccgtgggaaattgattgtcggcaccggcagcaccaatgcgccgtggcatttccagggcgcggacggcaagttgcagggttttgatatcgacattgcgcggatcgtcgccaaaggtctgttcaacgatccgagcaaggtcgagttcgtggtgcagtcgtccgatgcgcggattcccaatctgctgaccgacaaggtcgacatgagctgccagttcatcaccgtcaccgccagtcgtgcgcagcaagtcgcattcacgctgccgtactaccgcgaaggcgtcggcctgttactgccgaacaacagcaagtacaaggaaatcgaagacctgcaaggcgctggcgacagcgtcaccgtggcggtgctgcagaacgtctacgccgaagaactggtgcaccaggcactgcccaaagccaaggtcgatcagtacgacagcgtcgacttgatgtatcaggcggtgaactccggccgcgccgatgccgccgccaccgaccagtcctcggtcaaatacctgatggtgcagaaccctggccgctaccgcagtccgacctatgcctggagcccgcaaacctacgcgtgtgcggttaaacgcggcgatcaggattggttgaatttcgtcaacaccgcgttgcatgaggccatgaccggtgttgaattcccgacttacgcggcgtcgttcaagcaatggttcggcgtagatctgccgtcgcccgccatcggtttcccagtcgaattcaaatgatcccgtgagagtggggcgattcacgtcgccccgctcaaggtactgctgactatgaactatcagttgaactttgccgccgtgtggcgcgatttcgacaccttgctggcggggctcggtctgggcctcgaactggcactggtgtcgatcgccatcggctgtgtgatcggcctgctgatggcgtttgcgctgctgtcaaagcatcgcgccctgcgggtgctggcttcggtgtacgtcacggtggtgcgtaacacgccgattctggtgttgattctgttgatctactttgcactgccgagccttgggatccgtctggacaagatcccttcgttcatcattacgttgtcgctgtatgccggcgcatatctgaccgaagtgttccgcggcggtttgctgagcattcccaaagggcagcgcgaagccggactggcgatcggtcttggcgagtggcaggtcaaagcctatgtcaccgtgccggtgatgctgcgcaatgttttaccggcgttgtcgaacaacttcatctcgctgttcaaggacacctcgctggccgccgcgattgcggtgccggagctgacctattacgcgcgcaagatcaacgtcgaaagctaccgggtgattgaaacctggctggtgaccacggcgttgtatgtcgcggcctgttacctcattgccatgctgctgcgatacctggagcagcgtttggcaatccgccgataggaggctgcgatgtacgaatctcccagttggttacatgaattgtgggtcgcccgtgaaccgctttggcagggtttcctgaccagtgtgcaagtgtcggcgctggcaattctgctcggcacgatgctcggcgtggtcgccggtctggtgctgacctacggcaagttctggatgcgcgcgccgtttcgtttttacgtcgatctgattcgtggcacgccggtgtttgtgctggtgctggcctgtttctatatggcgccggcgctcggctggcagatcagcgcgttccaggccggcgccttgggcctgacgctgttttgtggctcgcacgtcgccgaaattgtccgtggcgcgctgcaagccttgccccgcggacagatggaagcgagccaggccatcggcctgacgttctaccaatccctcggctacgtgttgttgcctcaggcactgcggcagatcctgccgacctgggtcaactcatccaccgaaatcgtcaaggcctcgaccttgctctcagtgatcggcgtcgccgaattgctcctcagcacccaacagatcatcgcccgaaacttcatgaccctggagttttacctgttcgccggttttctgttcttcgtcatcaactacggcatcgaattactcggccggcacattgaaaagcgggtggccttgccatgactgaagctcaagtttccaacgttcaaaacggccagccgctgctggacatccgtggtttgcacaagcagtacggtgcggtcgaagtccttaagggggtcgacttgagcatgcagcgcggcaacgtggtcacgctgatcggctccagcggttcgggtaaaaccacgctgctgcgctgcgtgaacatgctcgaagagtttcagggcgggcagatcctgctcgacggcgaatcgatcggctatgacgaaaccaacggcaaacgcatcagacacgctgaaaaagtgattgcccgccatcgcgcaatgaccggcatggcgttccagcaattcaatctgttcccgcatctgaccgcgttgcaaaacgtcaccctgggcctgctcaaggtgaagaagatgcacaaggacgaagccgtagtgctggccgaaaaatggctggagcgcgtcggtttactggagcggcgcaatcactttcccggccagttgtccggtggtcagcagcagcgcgtggcgattgcccgtgctatcgcgatgaacccgagcctgatgctgttcgacgaagtgacttcagccctcgacccggagctggtcggcgaagtactcaacgtgatcaagggcctggccgaggacggcatgaccatgctgctggtgacccacgagatgcgttttgcgtttgaggtctcggacaagatcgttttcatgaatcaggggcgaatcgaagagcaggggcctcccaaggagctgttcgaacgcccgcaatcaccgcgtctggctgagtttctgaaaagcacgcggttttaatctttcgttttgtaatcaggagaaatacccatgagcattactcgttacggcaccggcagcaccgccgctggcggccagccacgcccattcgcgcgcgctgttgaggcggatggctggctgcatgtgtccggtcaggtgccggcggtggatggcgagatcattgttggtggcattgtcgagcagacccaccagaccatgaagaacctgatcgcgattcttgaagaggccggttatggcctggaagacgtagtacgcgccggggtgtggctggacgatccgcgtgatttcagcagcttcaacaaggttttcggcgagtacttcaagcccgaacatgcaccggcgcgggcctgtgtgcaggcgagcatgatggttgattgcaaggtcgagattgattgcattgcgtacaagaagaaaccctgaccaatacgcggatcgttcctacgctctgcgtgggaatgcctctcggaacgctccgcgttccaaggacgcagagcgtcccgggctgcattcccacgcggagcatgggaacgatcattagcggtaaactcccggcgactttgaatgggaaccactgaaatgaccgaagacaccatcaagcgccgggcccgcggtctggaccgggcgttcgatatcctcgatttcctcaaggaagtcggccagccgctgcgcccgaacgacatcgccaacggcatcggcagcccgaaatccacggtctacgaactggtcgcttcgctgctggaacgacggattctcgagccggtaggcaaggacggtcatgtctatctgggacggcaactgtactttctcggtcaagcgcatttgcgccatttcgacctcagtcgcgaggccgatcacgccctgcaggagatcgtcagccagacccgtgaaaccgcgcagatgtgcttgctcaacgggcgcaaatacacggtggcgttgatgaaggagggcgagcggcatttccgcatttcctccgacatcggcgaaaacgcgccgatcccgtggacggcttccggacgcctgctgctcgcgcacttgagtgatcaacagatcatcgacctgatcgacgaagacgactacatcctgcccgatggcgagcgtttgcctctggaacgttttctcgcggaaatccggcaggcgggtatcgatggatttttctccttcgacagcgtcgccgacaccttcacccattgcttcgccgcgccggtcaaagaccgcaatggcatcgcgatttgcaccttgtgcatcgtcgctccacgggccgatgcgaagaacaattacaacgactatcgccgggttctgatcgagagcgccaacagcctcgcccggcgtatcaacgaataaccgcggctgcctgcggccgcgtaaaaagtgaggagttcgaccatgacgactgccatcaatactgctgtggaaaagggcgacgcggccattggcgcgcacctgacgcgtgacgtcagcctgccagcgctggtgctgcatcgcgaggcgctggagcacaacattcgctggatgcagaagttcgtcagcgacagcggcgcgcaacttgcgcctcatggcaaaaccagcatgaccccggcactgttcaagcgtcagctcgacgccggcgcgtggggcatcaccctcgccagcgcgacccagactcgtgccgcttacgtccatggcgtacgccgcgtgctcatggccaaccaattggtgggcacgccgaacatggcactgattgccgatctgctcgtcgatcccgcgttcgatttccattgcatggtcgatcacccggacaacgtcgccgatctcggtgcctacttcgcttcgcgcggggtgaaactcaacgtgatgatcgaatacggcgtgatcggcgggcgttgcggttgccgcagcgagcaggaagtcatcgaactggccaaggcgatcaacgcccaaccggcgctggccctgaccggcatcgagggctacgaaggggtgattcacggcgatcacgcggtcagtggcattcggcagtttgccgcgtcgctggtgcgtctggcggtgcagttgcaggacagcggcgcgttcgcgatcgccaagccgatcatcaccgcttcgggctcggcgtggtacgacctgattgccgaatcgttcgaaacgcagaacgcggcagggcgtttcctcagcgtgttgcgtccgggcagttatgtggcgcatgaccatgggatctataaggaggcgcagtgctgcgtgctcgaccgtcgcagtgatttgcacgaaggtttgcgcccggcgctggaagtctgggcgcatgtgcagtcgctgccggaacagggttttgcagtgattgcactgggcaagcgtgacgtcgcgtttgacgccggtttgccggtgccgttgttgcgttacaagacgggcgtcgtgccagccgtgggcgatgatgtcagtgcctgcaaggtcacggcggtgatggatcaacacgcgttcatgacggtggcgccgggcgttgaattgcgtgtgggtgacatcatttcctttggtacgtcgcacccgtgtctgacgttcgacaagtggcgtgtggggttgttggtggatgagcagttgtcggtaatcgagcgcatggagacttgtttctaaggctcgagaccgagtcgcggccaatcgctggcaagccagctcccacagggttcagtgttgattaaaaaatttgtgagcgacatgaatccttgtgggagctggcttgccagcgatgaggcccgcccagacatccgcgcatcaacggagacagcacaagatgaacaccctgagccccttgggcccgaacaccccgcgcatcgccctgatcggcgaatgcatgatcgaactgcagcaacgcgccgacggcagcctgcagcaaagcttcggcggcgacacgctcaacactgcggtgtacttgtcccgtgcaatgggcgacaaggcccgggtcgactacgtcaccgcgctgggcgacgacagcttcagcgatgccatgtgccagatctggaccagcgaaggtatcggcctcgatctggttcaacgcctgccgagtcgcttgccgggcctgtattgcatccagaccgacgccaacggcgagcgtcgtttcctttactggcgcaacgaagcggcagtgcgcgattgtttcaccaccccggcagccgaaccgattctggcggcgttgccggattacgacgtgttgtatttcagtggtatcaccctggcggtgctcggtacgaagggccgtgagcgattgattcagaccctgatcgaagcgcgtcagcgcgatgcgcggattgtcttcgacaacaactaccgcccgcgcttgtgggcttcggtggacgaggcgcgtgaggcctatcgcagcgtattgccgtacgttgatctggcattgttgacggtggatgacgaacaggcactgtttggttttgccgattgcgatgcggtgtttgatgcttacgcgcagttcggcaccccggaagtggtgctcaagcgcggcgccgaggcgtgcctgattcgttgtgatggcgaggcctttgaagtgccggcgcagaaagtcgcgaaggtggtggacaccaccgcagcgggggattcgttcagtgcggcgtatctggccagtcgactgctcggcgggagtacggaagaggctgccgaggcggggcatcagttggccagccgggtgattcaggtgcccggggcattgattcccagaacctgaatgcaatccctgtaggagctgccgaaggctgcgatcttaaaaaccagatcaaaagatcgcagcctcgtttcactcgacagctcctacaggaaagcgatatttaatcccggtaaaacacctgcaccaggtgatagccgaacttgctcttgatcggcccatgcaccgtacgcagcggttttttgaagatcaccgcgtcaatcgcgccgaccatctgccccggccgcacttcacccagatcgccgccgcgcttgcccgacgggcaggtcgaaaatttcttggccagtacatcgaacgcttcacctttggcgatgcgttgcttgagctgttcggcctcttcggcggtttttaccagaatgtggcgggcttgggctttcatcttgcgatacctgataacggggtgacggcggggcgcggattatgcctcaagtcacggattttgactgatcatcgtgcggatcttgttcgccagcagctcaatggcaaagggtttggcgaccatgtccataccgtcttcgagaaacccttgccgctcggcggccttttgcgcgtaaccggtcatgaacaatattttcagccctgggcgatgctggcgggcgatctccgccagttgccggccgttcatgccaggcaggccgacatccgtgaccagcaggtcgacccgcagatcagactccaacagcggcaaagcggttttcgcgtcttcggcctcaaaggcctgataacccagctcgcgcagcaggtcgagcaccagcatgcgcaccgccggatcgtcctcgaccaccaccacggtttcgccggttgcagccggcgccggctgctggatcggcgcactggccgggcgttccagctccaagccctgcaggcgtggcaagtacaggcgcacacaagtgccttgccccgggaggctgtcgaggctcacatgcccgcccgattgctgagcgaacccgtaaatcatcgacagcccaagcccggtaccctgaccaatcggtttggtagtgaagaacggatcgaacgccttggacctgaccgacgccgtcatgcccgaaccgttatcgctgaccgcgagcatcaggtaatcaccggccttgaccggctccagcgtggtgatgtcgctgccatcgaggtagacgttggcggtttcgatcagcaactcgccgccgtcaggcattgcatcgcgcgcattgatcaccaggttgagcagggcgttttccagttggctgacgtcggtgctgacgggccagaggtcatcggccagctgcaacttgagttcgatcggatcacctttggtccggcggatcagatcttccagggaatgaatcagctcattgacgttgagctgcttgcgatccagtgactggcgtcgcgaaaacgccagcagacgatgggtcaaggctgctgcacgattggccgaggagactgctgcttcggtaaaacgcccgatctcgttggcgcggccatcggcaatatagcgctgcatcaaatcgaggctgccgatgattccggtgagcatgttgttgaagtcatgggcaatgccgccggtgagctgaccgaccgcttccattttttgcgcatggcgcaacgcatcctcggcacgctcgcgttcgaacatctcgttctgcagacgctggttggcctgcgccagttgttcggtgcgggcgctgacccgttcctcgagcgtttcattgaggttgcgcagggcttcttcggttttcttgcgctcggtttcatcgatcacgaaaatgtagaaaccgttgaccgcgccgtccgcaccgtgacgaggcaagtagttcatcaaggcgtggcggttgctgccgtcgcggtgcgtggtgtacaggctgaaggaacaagacctgccagccagtgcttcggcaatgtacggcgcgcgcaggaagtaggcttcctcgccgataacgtcgcgaatggttcgaccatagagttcttgcggggtcaggccataccagtccagatacgccgcgttgttgagcctgaagcgttcttcgcgatcgacatagctgatcaggatcggcatggcgttgatgatcagctgcaattccgtctggctctggcgcaacgcctgctcggtgtgtttgcgctcagtcaggtccagcgcggcgccgagaaaacgcactggccgaccgtgatggtccttgtagcagcggccccgggcaaacacccagcgcaactcgccatcgggctgcaacaggcgatattcctcggcgtactcggtgccgtgggtgatgcagtgcttgatgctgcgcgcgatcatggcgcggtcttcagggtgcacgccttgcaggtaagcgctgatcggcagctgatcggctcgggccggatcgacgccgtgcaactgcgcaaagtggctgtcagcaatgaagcggtcttcgccgatgtcccaatcccaggtgccgacagcgtcagtggcggccagcgccaattgcagacgttcctcggattcgcgctgggccttgaggctttcttccgagcgttgtttgagttcgagggcgatccgccgccgttcattggtttcgatggcggtgaccagaatgcccgccacttgcgcggtttcatcgcggatcgggctgtaggtcaaatccagccagaagtcggattcctgcccttcacgttgcagggtaaagcgtcgctcgctgtaggtgcgcacttggccttgcaggacggcgctgtagatcgggtcggtaaagtctcgaagttcaggccataccagatgcgccggttgtccgaaagcgtgcggatgcttgttgccggcgagcatggcgaagccgttgttgtagatctgcgtgagctgcgggccccagagcaacagcatcggcatcggcgagtggagcacgatgtccacggcggtgcgcaggctttgtggccaggcactggcatcgcccagcgggctgcggctccaatcggtgcgggcgatcagcgcctgagcatcgtcgtgggtgggtacggcattcatcgcatcagtcctgcgtgtcgttcgttaagcggcgtctactattcttcagggacggtagacgctcaatgtaccgctgcgtcacggcagcagggcatgtctgaatattggaagcttcgcgggtactggtggccatggaaatcgatgcactgttaacacgttttgcccgggagcacggctcggacctgttcttgtctacgggagcgccacccagtgcgcgttttcagggggtgctgacggcgctgagtgcgcagccgctcagacccggcgaggtcgcgaccatcgccaattccctgatggacgccgaacagcgtcaggagttcgaccgcgatctggaaatgaatctggcgatctcgcgcgccggtatcggacgttttcgggtcaacctgttcaaacaacgcaatgaggtgtcgattgtaatccgtaacgtcaaactcgacattccacgttttgaagacctcaagctgccgccggtgctgctcgaagcggtgatgctcaaacaggggctgatcctgttcgtcggcgccaccgattccggtaagtcgacgtcactggcggcgttgatcgatcatcgcaatcgtcacagtagcgggcatatcgtgaccattgaagacccgatcgagtacatccaccggcaccaacggtcgatcatcaatcaacgcgaagtcggtgtcgacacgcgcagttttcatgccgcactgaaaaacaccctgcgccaggcacctgacgtggtgctgatcggtgaaatccgcgaccgcgacaccctggaacatgcgctggcatttgccgaaaccgggcatctggtgctgtcgaccctgcacgcgaacaacgccaatcaggcgcttgagcgaatcatcaacctgtttgccgaggagcgccggccgcagttgctgcatgccttgggcaacaacctcaaggcctttgtttcccagcgattggtgcgcacgctggacggccagcgacgggctgcggtcgagttgctgctggggacgccgaccatcggcgacctgatccggcgtaatcagttgggcgagctcaagggcatcatggaaaaatccaccgagctgggcatgcagacgttcgatggcgcgctgcacgcactggtgctggaaggtgcaatcagcgaagacgaggcgctcaagcatgccgactcggtgaacaacctgcgcctgcgcttgaaattgcaggccgatgctgcaccggcgccacccacctcgggtgagtggggcttgatggaatgagcggattcagtcgtcgagttcagggcgctggcgaaactgctccagcgcctcgggattggccagcgcgtcggtgttcttgaccttttcgccgtgcaccacattacgcacggccagttcgacgaccttgccgctgatcgtgcgtggaatatcgctgaccgcgactatcttcgccggcacatgccgtggtgtggtattggcgcggatcacctgccgaatctgctgttgcagagggtcgtcgagtgttacgccgtctgccagacgcacaaacaacaccacgcgcacgtcgtcttgccatcgctgaccgatggcgacgctgtcgagcacttgcgggactttgtccacctgacgatagatttccgcggtgccgatacgtacgccgccggggttgagtacggcatccgagcggccatgaatcatcatgctgccgttgggcaattgttcggcgtaatcaccctgcgcccagacgccgggaaacagactgaaataggattgctgcagtttgctgccatccgggtcattccacaggccgatcggcatcgccgggaaatgccgggtacagaccagttcacctttctcgccagtcaccggttgaccggcgtcgttccagacttcaacggccatgcccaggctcttgcccatgatttcgccacgacgcaccgctgacagcggattgccattgacgaagcacgagacaatatcggtgccgccggacatcgacgccaggcacacgtcggttttgaagtcgcggtagacgaagtcataactttgcggcgacagcgccgagccggtgcacagcagggttttcaggctgcgcagatcatggctgtcgcgcggtttgctgccatcgctttgcagggtcgcgagaaactttgggctggtgccgaacacgctgatgcgttcatcgtcgatcagatcgagcaaccgctgatgatccggatagaacggcgagccgtcgtacaggactactgcgctgccgaccgcgagggccgataccagccagttccacatcatccagccgcaggtggtgtagtagaacaaacgctcgccggggccaagatcacaatgcaggccatgttccttgacgtgttgcagcaacacgccgccggtgctatgcacaatgcatttcggcacgccggtggtgccactggaatacagcacgtagagcggatgatcgaacgccaccgcgacgaaatccggatcgccgccgggttgataaaagtcatcccagagcgtcacttcggcgcgtgtccggtaatccgcgaggcgcgcttgcgggcgtgcgtaaggcacgacaataagctgcttcagtgttggcagccgttggagaatttcattgagcttggtggtttggtcgatctctttacctgcatagcgatagccggcgcaggtgatcagcaccttcggctcgatctggccgaaacggtcgatgacgccgtgcgtgccgaaatccggcgaagagcacgaccagatggcgccgaggctggtggtcgccagcatcgccaccagcgtctgccaggtattcggcatgcacgcggccacccgatcgccgaggccgacgccgcaagcctgcaaactggcctggaagccggcgacatgctcggccagttcggcccagctcagttgctcgcgctggccgttttccgccactgccacgaccgccacggcatcgtcacggcggcgcagcaggtgttcagcgaagttcagggtggcaccgggaaaccattcggcgctgggcatttgtgcaccttcacgcagcaccgcatcaggttgagtgtgaaaacggatgtcgaagaaatcgacgatgtcctgccagaattgtggacgctgctcgatgctccattggtgcagagcagggtagtcgtcgagattcagcgcatgacgctgattgaccgcgcgccggaaggtgtccatgcgcgattgggcgatacggttggcgtcgggttgccaaaggatgtcggacattgtttgcctcttgttttagcttcagatccagacacgggcagacacactccacaggtagtcagcagattccaatttcaccctgcacctgtgggaacgtggctggcccgcgatgaacgttaacgcggtctttcaaccgactactgcgccaaccacccaccatcaatattccacgccgcgccccttacctggctacccgcctcactgcacagaaacaacaccaactcgcccaaatgctgcggtgtgacgaactccagcgacggctgcttttcagcgagcaggtcatgctgcgcctgttgcggatcgacacccttggcggcgcgatcatcgatctgcttctgcaccagcggcgtcaacacccagcccgggcagattgcattgcaggtgacattgctggtcgcggtttccaggccaaccactttggtcaaaccgatcaccccgtgtttggccgcgacatacgcagccttgccggttgaaccgacctgaccgtgcacggaggcaatattgatgatccgcccccaacctttcgtgcgcatgcccggcaggctcaagcgcgtgctgtgaaataccgacgacaggttgatcgcaatgatcgaatcccaccgctcgaccggaaattcctcgacagcggcgacatgctggatgccagcgttattgaccagaatgtcgacgccgccgaactcacgctcggcgtaggcgatcatctcggcgatctgcgccgggtcgctgacatcggccggatgatggccaacccggccgccgaattggccgacttcggcgatgacgctcgtggcatcaccaaaaccgttgaggatcaggttggccccagccttggccagacttaacgcaatacccaggccgatgccgctggtggagccggtaaccagtgcggtcttgccggaaagagtggtcatgagtacctcacacaatgccagtggcgtagaaagtgccgatcacgacgaaaaccgcaagggtcttgatcagcgtaatacagaaaatgtctttataggcttcgcggtgggtcaggccggtgaccgcgagcagggtgatcaccgcgccgttgtgcggcaaggtatccatgcctccactggccatcgccgctacacggtgcagcacttccagtggaatgttcgccgcgtgcgcggcgctgatgaactgctcggacatcgccgccagcgcgatactcatgccgcccgacgccgaaccggtgatccctgccagtaacgtcacggtgatggcttcgttgaccagcggattgggaatctgcttgagccagtcagccaagaccagaaagcccggcagcgaagcgatcacagcaccgaaaccatattccgacgcagtgttcatcgccgccagcaacgcgccactcactgcgcttttgctgccctcggcgagcttgctgcgaatcgcctgaaagccgaacgccaacaccatcagaatgcccaccagcaaagccgcctgcaccgcccagattgccgtcagcttggcgatttcggtggtaaccggcgtagccatgcccggtagcgcgaggctgtgggtcttgccgtaccactgcggaatccactgggtgaacagcaggttcatgatgcccactgccagcagcggcgacagcgcaatccatgggttcggcagcttcaggtcttcggctgtttccggttcgttgcgtagctcggtcccgtagccttcaccggcgcgctgcgccttgttgcgctgacgttgcagaaacaacatgccggtgcagaagacgaaaatcgtgccgatcacgcccagccacggcgccgcccaagcggtggtattgaagaacgtgctggggatgatgttctggatctgcggggtgccgggcagggcatccatggtgaacgaaaacgccccgagggcgatggtcgccgggatcaggcgtttggggatattgctctggcggaacatctcggcggcaaacggatacaccgcaaacaccacgacaaacagcgacacaccaccgtaggtgagcagggcgcagaccagtacgatcaccagcatcgcctgtttggtcccgagcagacgaatggcggcagcgacaatcgagcgtgagaagcccgacagctcaatgagtttgccgaacaccgcaccgagcaggaataccgggaaatacaatttgatgaagccgaccattttctccatgaacaccccggtaaaggctggggcgacggcagacggatcggtcagcagcacggcgccgagggcggcgatcggtgcaaagagaataacgctgtagccacggtaggccgcgagcatcagcagcgcgagggctgccaaggcaatgatcacactcatggtgtgtctctccagaattgttatttttgtggttgaaacgggtgcaggagaggctaaagcgagatttgtgccatatatgtaagttattgaaatataaagatattaggtgtttttgtggggcgtgtttcaatgggttgtctccgtttggagactttttcggcagatcaaaagatcgcagccttcggcagctccgacactggattggatgaacctccgtaggagctgacgaaggctgcgatcttttgatctttaaatggataatctcaaatcagagataaagtctcgttattgagactcggcaatccccaacgcaaccattttcttatacaacgtcgaccgcccaagccccaaccttgccgccgcttccggcactttccccgcgcactgcgccagcgttgactggatcaactgccgatcaaagcgctcgcgagcctgcgcataggtttccacgggcagcgtttcaatcgtaggcgcagagctgcgctcaacctgagtcaacgtgccgatggctgcgcgaatatcgctctctgtcagcatcaggtcatcgctaagcaacgccgcccgttccaatacattgcgcagctcgcggatgtttcccggccaggcatgctggccgagcagttgcagcgcatcgtggtgcaattcgtgctggctgcgcagttcttccagaatcgcttcgctcagtgccggcagatcgtcaagacgctcgcgcaatggcggcacctggatcggcagtacgttgaggcggtaatacaagtcggcgcggaactcgccgcgtttgatcgccgcttgcagatccgtcgacgtcgcggcaatcactcgcacatcgctctggatcacctcgttggagccgaccggttcaaactctttttcctgcagaacgcgcagcagcttgctttgcaacggcagcggcatgtcaccgatctcgtcgagaaacagtgtgccaccctgggcaatctgcagtttaccggtgcggcccttgcggtcggcgccggtaaacgcgcccggtgcggtgccgaaaaattccgcttccagcaatgcctcgggaatcgccgcgctgttgatgctgacgaacgccttgtgcgcccgtggcgaagcactgtggatcgcttgcgcgagcaactccttgccggtgccggtttcaccgagcagcaataccggcgaatcggcgctggcactgcgtcgcgcacgacgtttgacttcaaggctggccgcgctggtgccgatgaagtgggcgaagttgtatttggtctggcgggcgcgcagcagcgaacgcgtcgaggccagttcttcctgcatgctcaggtagcgcttgagcatcggcgacaaggtgcgtaattcatcgaacagggcaaaaccgatggcgccgatgacgctgccggcatcatcgtggatcggcagacgcatcaccaccagcggctctttcggggtgtcctgcatgtccagcaggattggccgcccggtgcgcaccacttcgcgcagcaggctgccggggatcacgctttcgcagggtttgccgatggctccggcagcggactcgaggccaaagcgacgggcgtaacgctcgttcatccagacgatgttggcatcacgatcgacaatcaccgtgccttcgctcgattgctcgatgatctcgaacagcgagcggatcgccaggctgcgcacccgttggtagtccttgaggctttcggtggagttcatgtgcagacagatccggaattcgggttgttaatggcggcctcatcgctggcaagccagctcccataaggttcgcgattgttcacagatggggtgcgcacccgtgaaacctgtgggagcgggcttgccagcgatggccgcgactcggttttacgcctggcgccgatcatgcctggcgcggatgtgccgccgccaacagctctcgggtgtacggatgctgtggcgcgtcgaacacctcatgactggcaccgcgttcgaccacttggccatccttgatcacgatcatgtcgtgggcgagggcgcgtaccaccgccaggtcatgactgatgaacagatacgtcaggccatgcttttcctgaagatcacggagcagggcgaccacttgtttctgcaccgtgcgatcgagtgccgacgttggttcgtcgagcaggatcagcgccggtttcagtaccagcgcccgagcgatcgcaatgcgttgtcgctgaccgccggaaaactcgtgtgggtagcgatggcggctttcggggtcgaggccgacttccttgagtacgcggatcacttgctcatcacactcattggccgttgactcgcaatgcacctcaagcccttcgctgatgatttgcgccaccgacatgcgcgggctgagactaccgaacgggtcctgaaacaccacctgcatctgtcgccgccaaggccgcagttgcttctggtccaaaccatcgagcgcggtgccctggaaacggatactgccctcggaatcgagcaggcgcaggatcgcctgacccaatgtcgattttcccgaaccggattcaccgacgatgcccagagtcttgccgcgctggatactcaggctgatgccgtccactgcacgcaggtattgcttgcgctgaaacagcccgccaccgatgacaaactcgactttaaggtcttcgacttgcagaacattctcacgctcatcacggggcaacgcttggccgtcgggttcggcgttgagcagcacgcaactgtaagggtgtttcggctcggtaaacagcgtttcgcacggtgcctgctcgacaatctgcccggccttcattacgcagacgcgctgagcgatgctgcgcaccagattgaggtcgtgactgatcaacagcagggacatgcccaaacgttgttgcagggatttgagcagcagcaggatcttgcgctgcaccgtcacatcgagtgcggtggttggctcgtcggcaatcaacagttccggttcgcaggccaatgccatggcgatcatgacgcgttgccgttggccgccggacaactgatgcggataagccttgagccgctcctcgggtttctggatgccgaccaggccgagcaattcaaggatgcgtaaccgtgccgccttgccgccaaggccacggtggagcaacagggtttcgcctatctgtttttcgatggtatgcagcggattgagcgaggtcatcggctcttgaaagatcatcgcgatgcggttgccgcgcagttcacgcaacaccttcgggtcggcccccaccagttcctggccacgataacgaatgctgccagtggtttgtgcatcgccttcaggcagtagttgcagaatcgaatgcgcggtcaccgatttgcccgagcctgattcgccgaccagtgccaggcactcgccgggacgaatatccaggcacaggtcgcgcaccacgttctggccatggaaagcgacattgaggttacgaatttcaatcaggttgtcagtcatggtcacgcttcaggatcgtgggtcgaacgcgtcacgcagcgcttcgccgatgaacaccagtaaggaaagaatcagcgccagggtgaaaaacgccgtcaaccccagccagggcgcctgcaggttctgcttgccctgaccgatcagttcgcccagcgaagcgctgccggcaggcatgccgaaaccaaggaaatccagtgcggtcagtgtcgagattgcccccgtcagaatgaacggcagataactcagcgtcgcgttcatggcattcggcagaatgtgccggacaatcactttgcggtcagtcaggcccaatgcgcgcgcagctttgacgtattccagattgcgcccacggagaaactcggcacgcaccacatcgaccagcgccaaccatgaaaacagcgccatgatccccagcagccaccagaagttcggctcgacgaagcccgagaggatgatcagcaggtacagcaccggcaaccctgaccagacctcgagcaaacgctgtccgagcaggtcgacccagccaccgtaatagccctgtaacgcaccggccgcaatgccaatcagcgcactgacgaatgtcagcatcaaagcgaacagaatcgatacgcgcgcaccgaaaatcacccgcgccaacacgtctcgcgcctgatcgtcggtgcccagccagttgacgcccgtcggtgggcttggtgccggtttgttgaggtcgtagtttggcgtgtcgtcactgaacggaatcggtggaaacagcagccagccgccgtccttgcgaatcaggttctgcacatagtcactgcggtaatcggcctgaaacggcaattggccaccgaactcctgttcggtgtggcgcttgaataccgggaagtaccactggccctgataactgaccaccaacggcttgtcgttggcgatcagttcgccgcccagcgtcagcacaaacagaccgataaacagccacaacgaccaccagccccggcggtttttcttgaaacgttcgaaacgccggcgacccagcggcgagagcttgaacatcaggcattcctcgcggcgaagtcgatacgcgggtcgaccaaggtgtagcagaggtcgccgatcagttttatcagcaggccgaacagggtgaagatgaacagcgaaccgaacaccaccggatagtcccgcgatactgccgcctcgtaactcatgcggccgagaccgtcgagagagaagatcacttcaatcagcaacgagccggcaaagaacacgctgatgaacgcctggggaatgcccgagaccaccagcagcattgcgttacgaaacacatgcccgtacagcacgcggcgttcgctcaagcctttggcgcgagcggtgaccacatactgacgcgtgatttcattgaggaacgagtttttggtgaggatcgtcaacgttgcaaagccgccgatgaccagcgcagtcaccggcagtaccaagtgccagaagtagtcggcgatcttgcccagggtcgacagcgaatcaaagttgtccgagaccagtccgcgcaccgggaaccagttcaacgacgtaccaccggcaaacaccacgatcaggaacatcgcaaacagaaacgccggcatcgcataaccgatgatgattgccgtgctgctccagatatcgaaatggctgccgtggtgcacggctttgcgaatgcccagcgggatcgacaccagataggtgatcagcgtggcccagagtccgagtgaaagggttaccggcattttttcgagaatcaggtcggtgaccgtggcacctctgaagaagcttttgccgaagtccagctgcgcgtagtttttcagcatcagccacaagcgttcatgggccggcttgtcgaaaccgtactgtttttcgatatccttgatcagttgcggatcgaggccacgactcgcccgagaggtactgctcatggtttcgctggaaccgccgccgacattgccaccgccgatcccttgcaggtgcgcaatggcctgctccaccgggccacccggcgcggcctggatgatgacgaaattgaccagcaggataatcaccagcgtcggaatgatcagcagcaggcgccgtagtatgtaagcccacatcagtgcggccctccgggtctgcttcgactgattttttcagcggtcatctgttgattggtcagcgccgtgctgctgatctcccaccagctatcgatggcttcgtcattgctggcttgaactgtcggtatgccaaagcggttccaccagacggtcgacgtgcctggcgggtagtaattgggaatccagtagtagttccattgcaacacccggtcgagggcgtgcgcgtaatgcagcatgtccgattgggtagaggcgcggatcagtccgttgatcaacgtgtcgactgccgggtttttcaggaccatgtagttgttggcccccggatcgttggccgacgcggaaccgaagtagttgagcagctcgcctccaggcgcggtggtgaccggatagccagtgacgatcatgtcgtagtcgcggctcatcaggcgattgacgtactgcgaggagtcgatccggcggatgttgaggtcgatgccgatctgcttcaatgtgcgcttgtacggaagtagcaggcgatccatgccgttctgactgaccagaaacgtgaaactcaggggctcaccttcagcattcaccagttgatcgccgtccggtttccagccggcctgttcaagcagttcgagagcttgcagttgtttgtcgcggatgatgccgctgccatcggttttcggcgcttggaagactttcgtgaagacttcgtcggggatctgtccacgcagcggttcaaggattttcaactcggcggcatcgggtaaatttcccgcggcgaggtcggtgttggagaagtagctttgctgacggatgtacaggttgcgcatcatctgccgattgctccattcgaaatcccaaagcatggccagcgcctgacgcacacgacggtcctggaacatcggtttttgcagattgaacacaaaaccctgggccgattgcggggcctcggtggccaggtgagctttctgcagacgtccgtcgctcaacgccgggctgtcgtagccgatcgagtatccggtggcggagaactcgcggttgtagtcgtaggcgccgccgcgcaacacctggcgggcaacgtcggtatcgccgaagtactcgatgctgaaatggtcgaagttgtacaggccacgactgaccggcaagtccttgccccaccagtcggcattgcgttcgaaggtgatgctgcgcccggaatcgaccttgccgacgcgatacggtccgctgcccagcggcggttcataaccgccaccgccggcgaagtcgcgactcttccaccaatgctcggggaacaccggcagggtcgcgatatccagcggcagggtacggttttcgttgttcttgaagtcgaaacgcacggtcaacggtgcttccacttcgacgcctttgacgtcggcaaactgagtgcgataacgcagactgccctgtgtcatcagcagatcgtaggtatagcgcacgtcttcggcggtgatcggtttaccgtcggcgaagcgtgccttgggattgatgaagaagcgtaatgaaagcccgtcatccgaacgctcgatcttttgtgccaccagaccatagacggtgtaaggctcgtccatcgagcgctgggccagcggcgaatacagcaggccgtcgatctgcgtgacgccgatgcctttgtcgatatacggcagcaaatggtcgaagtgaccgatttctattgccgagcggcgcattgtcccgcctttcggtgcttgcgggttggtgtagtcgaaatggctgaaaccggcaggatacttggcgggttcgccatacacggtcagcgcgtgttgcggtgcagcattcacaccgcaggcgcccgacagcagggcgagggcggtaagcatcaatgttgggaaaaccagtcgcattgtcagccttggaaccgggtaatcgataagcgcaagttgtacgcgagaggcgcgccagtcgccagccgtatgtgtaactgaaacacaacggcccaccaaaaggcgggccgttgcagagcaatcggacgacgaatcagtcctgacggctggtgacttccagcaggtgataaccgaactgggtcttcaccgggccttgcacgacgttgatcggtgcgctgaagactacggtgtcgaattccttgaccatctggccaggaccgaacgaacccaggtcgccgccctgacggctggatgggcaagtggagttggccttggcgacttcggcaaaatcagcgccgccttcgatctgggccttgagttcgttgcacttgtcttcgctggaaaccaggatgtggcgggcagtggctttagccatggggaaaatctccgatctatttcagtaaagtgtggagcctaccggattcagtgggtgaattctcggcaaagttccattcagtgggttcgcccccggtttacaagtgcacggcctgcaggcgcatggcgtgctctatatagaggtcgatcggatcaggtgtgagtgatcgcaagaccttgggcctgcgcaggctgtcgaggtgatcgaaaggatagtccgaacggatcacgctgcccagatgcgagctgtagcgaccgacgagtccgtcgttctgccaggcttcggtgcaaaagtgtccggaaaaggcccggcacacggcatgtaacgggtcgagcggacgaggattggccagcggattttctggcagtgtgccgctccacgaatagtaccgaacgccattgacctgttccgcaccttgccctccccagacaggaggcagaccttgcgggtatttacgattgaaacgcgcaacaccttcggtggtcaacgcgttgagtgctgctatggcgttctgcggcaacgcgagttgaccgctgagcaacgacaggaagttcgcgaactgcgtggcgatttcctcggcgagatgttccggtatctgtccgggaaccagcgctttgcgcaacaggtcggccagttccgagccatgatttgggccgctgaccgaagtgacggatgcgacgctgctggatgccagtgcggcagcgtaacggcatgccagggcaccctgactgtgcccgatcaaattgaccttgcctgctcctgtgtctttcaacacccgcgcgatctgcatgagtaattgctggccacgaacttcgttgtcatgggtggccgatagctgcggcacaaacactcggttgcccgcaccctgcaatgcctgcttgacatcttggaacagctcgaaacggcctatccgctcaaaaccgaacaggccgtggaccaacaggatgggatagcgggttgttgcattccgttgcatgttcctacctcttttacagacgttcataggtgattccgccggatcactgtaaatcacgttgtcatgcagtcggtgtccgaaaataccgcagtattgaagtgaaaaaggactaaaagctgtacgacatttcagctctgtttgcgggcatggtcggaacattcagcaatctttagcgctatttttacgggttcaatacctgtgccttacgccttcagacgcatttccctccgctatggagttgtcgaggctgacatcgacagcgcaagcgttgctatttaatggctctcattcgacgttgttgtgatcagcgacgttttatccagggaatggagccacgaatgaccatgtatgacgctaataccgatgcttgcaagacgctcgcaacagacacctcattgctggatacccattcagccctgcagccaaaactgagtttccgggtgcaaggcgagacactcgaattcagctatcggccatggcctgttacggaggctgcgaccgtccggcatttgcctgcgccggctctcgaagttctggagggcggaatgatcgatccctcactggacaaggcctttgttcgggttgcgccttacccgcagatgaaatgtggtgacaagctggtcttgaattggtgcggtctagatgctgatggactgtcctacgaatctgtaacttcgcgttttgtcagtgccgcgcaagtggggcacgaggtcgtgttcgtcatcaagggtgtgcacatcgccatgctggaacgcggctcggtggaaattcactggacgctgttcagcgtcaacctgcctgagccgatttcatctgatcgcttgcaattgaacgtaggtgatcccgaacctgatctgctggcaccacttatcgaagaaaccgtgggcggaacactcgatccggcgcgtgtcgagaaaggtacaagcgtgattgtgcgtccgtatgcacggatggccgtcggggaccggatcctgcttggctggcaaggtgcaaaaagtgaagagacgttcagtgatgagttgatggtcgaagcttttgccgttcgcgaagagctttctttctggattacccacgaacacttggcctcgcacaccggacaaacggtaagcctcagttatcaggtcatatcggcagagggtgaattgaggcagtcggcgatcttgagaatcctgatcgctcccctcgttcgaggcgagctggcggcaccgcaggttctggatgcggagggtggcgaacttgatgtcgccgattccattgatggcgtgacggtggtcatcgtcgatgctcaggcagaggagggcgagttggtgtacctgcgctgtgatggtgagtatttcaatcaccgtgatgatcgcgacatcacccgggaaaccgccggggagcctctggtgtttattgtgccacaccgattctggcgggagcaccgggaaacggtggtgcaggtgtcgtatacggtggagcgactggatgatgtcagtcaggcttccagcgctacccgcatacgtgttcgtgcgtaatttccgtgcgggctgatcagcctttcagcctttgcggaccaggtgtccgcaaaggctgttggcgaggtcaggcctgagattgcgcgcgaaggcgttcggcggcgttcagcagcaagcgctccgttgcggcgaaacccaggcaaccgtcggtaaccgagacgccataacgcaaagaggtactgagtggctggcaaccttcgaacaggtgggactcgatcatcatgccgatcagcgaacggtcaccgtgcaggcgttgctccactacatcgttgaatacatcaggctggcgcaacgggtctttaccgctgttggcgtgactgcaatcgaccatgatccggctcggaatcttcaggcgggtcaagtcggcgtggatccgggcgacgctttcgcggtcgaagtttggcccttgatggccgccacgcagtaccagatgggtatcaggattgcctgtggtctggacaatggctggatgtccctggctatcaacgccgaagtgtcggtgcgggtgggaagcggagcgcatcgcatcgactgccacggtcacgccgccatcggtgccgtttttgaaaccgaccggcatgctcaggccgctggccatctcgcggtggatctgcgattcggtagtgcgtgcaccgatcgcgacccagctgagcaaatcgtcaaagtatccggctgccatgggttgcagtatttcagtggcgattggtagcccgcggcggatcatttcgatcatcagctcgcgggacagcgtcagaccaccggccatgtcgtcactgccgtccagatgtggatcgtaggccaggcctttccaaccgatggtggtgcgcggcttttcgacataggcgcgcatgaccagcaacatcatatcgctgacttcgtcggcgaggcgtgcgagtttgtctgcgtattcaatggcggattgcgggtcgtggatcgagcaaggtccgacgatcaccagcaggcgctggtcgtcgccatcaagaatggcccgcaccgcttggcggtgggcggcaatctgctgactcagggcgctggtcagaggcaattgctgtttgagttgcaacgagctgggcaagcgcagagtcagtgcttcgttggcagaatcaaaagtggaaagtggcagggcagaaacggacgagttcatattcggtcttcctgggcaggcggcgggtgtttcccgctcgctcggccctattggggtgttcgacagttggccgtattggctacgtgtgtgtgcttgccacctgtaggtgaccgatcggaggcggcaggctgtcccgagcggaggctggtaaatcgccaggcgaaaaaacggtcgtaacggtaataagtggcgtaggtcatgtcgtaatcctcaaagtgtctggtgtgttgctggaaaatttgtgcctgaaaaaacaaaacccccggtcgggaggccgaccgggggttgagatttctcaggtggcgacccgtcttcatgggcgccgtgtggggtatcaggcgcgctagtggctaaaccaatacccaaaataaaagcttgcaggagcgcagacgtcattcacccgggcaaacgaaaccgagcgcgaggcgcttgcggtacgtagctgtgaaagggtgttgaacatggtctgtctccgatgaatgcgccgagcttactagaggcagatacgcatcagcaatcagaaaatgctatcgattgcacaggacaatgcctatcgcttgagcgccgcaacagttgtgacacactctgcgctttgcctgaaaccaaggacgaaacatgacaactctgaccatcgctgctgctcaatcggtttccattgccggtgatcccgccgcaaacattgtccggcacatggaattcatcgaattggcggcgctacacggtgtcgagttgctggtgtttcccgagttgtcgctgaccggttatgagggtgaagtggcggcggcattggccattgatccgcaagacgccgtgcttcaaccgttaagggatctggcacaaaagcgcggcatcacggctgtcgtcggcatgccgattcgtcaggagggcagttcggcagtattgattggtgccttggtattgggcgccaatggcacgcttggggtgtacagcaaacagcatctgcattgcggtgaagagctcatttacgccgccgggaacggtggcgcagccctgcaaatcggcgcggacacggtggccctggctgtctgtgccgatttttctcacgccagccatgcggcggccgctgccgagttgggcgccggtctgtacgctgcgggcgtattgatcggcgagaagggctacgaacctgacaccgcgatgctgcagggatatgcccggcaacactcgatggtggtattgatggccaaccatggcggtctcaccggaggctggcaatcggccgggcgcagcgccgtgtggtctgaagacggcatgttgatcattgccgctcccggtgctggcgatgaattggtgatcgctcgtcgcgaagcaggctcatggcaggggcaggtcgtcagcctcgcgagggctgtatgacctttcaaatgcgccgggccacgcagggtgacctggcatttgtgcgaactttgacctgcgagaacatgctgcgctattacaatgattacgatttgttgtggcaggatgaggcgttcgacgttgcctgggccggacgtgagaactggttgatgatccgtgagcaggcgcccttggggtttttcagcctcagccgcgatgcgcgggcgctgtatatccgcgaactgcaggtgacgcgggcgtttcagcgccagggcgtgggttcctgggcgattgatcaggttattgccatggctcgccgcgacggtaaccccgctgtgcgtctaacggtattcaaaaataatctggcgaaaaacttgtatctgagaaaaggctttgcagtacagggtgaggacgagtgtttcctgaggatgcagctcgatatcggtacacctgtgctctgaaacccacggctggcaagccctcaatgatgaattgaaactttttaaatgctgcttgccgctaggtctgtctggcagtttttgctaaggtgtccggcatcccaataagaccatatcgcgaggtgtctgcttgattagggtgctagtggtcgatgaccacgatctcgttcgtacaggcattacacggatgctggccgatatcgatggcttgcaggtggtgggtcaggccgagtcaggtgaagagtccctgatcaaggcgcgggaattgaaacccgacgtggtcctgatggacgtcaagatgcccggcatcggcggtctggaagccacacgcaaactgttgcgcagtcagccggatatcaaggtggttgccgttaccgtgtgtgaagaggatccttttcctacaaggttgttgcaggcaggcgcggcgggttatctgaccaaaggcgcagggttgccggagatggttcaggccattcgcctggtattcgccggccagcgctatataagcccgcagatcgctcagcagttggcgatcaaatccttccagccgaccaacgattcgccgttcgatgccttgtccgaacgggagattcagatcgcattgatgattgtcagctgtcagaaggtacagatcatttccgacaagttgtgtctgtcgccgaaaaccgtcaacacttaccgttatcgcattttcgagaaactctcgatcagcagtgacgtcgagttgacgcttctggcggtgcgtcacggcatggttgatgccagcgcctgatcatgactgaagcattcgattccggcgcctttctgtcgaccgtcagcgggcgccctggcgtttatcgcatgttcgacagcgacgcgcgtctgctgtatgtcggcaaagccaagaatctcaagaagcgtctggccagctattttcgcaagaccgggctggcaccgaaaacggcagcactggtcgggcgtatcgcccaggtcgagacgaccatcactgccaatgaaaccgaagcgctcttgcttgagcaaacgctgatcaaggaatggcgaccgccgtacaacattctgttgcgcgacgataagtcctacccttacgtgtttctgtccgacggacaattcccacgtctgagcatccatcgcggcgccaagaaagccaaaggcaaatacttcggcccgtatccgagtgccggtgccattcgcgaaagcctcagcctgctgcagaaaaccttttttgttcggcagtgtgaagacagctactacaagaaccgtacccggccatgcctgcaatatcagatcaaacgctgcaaggcaccctgtgtgggactggtcgagcctgaggtctatgccgaggatgtacgtcactcggtgatgttcctcgaaggacgcagtcatgcactgaccaacgagctgtcaacggcgatggaagaggcggcgatcaaccttgaattcgagcgcgccgctgaattgcgtgaccagattgcactgctgcgtcgggttcaggatcaacagagcatggaaggcggcaccggcgatatcgacgtcattgcggcgttcgtcaacccgggcggtgcctgcgttcatttgatcagcgtgcgcggcggaagggtgctgggcagcaagaatttcttcccgcaggtgggtattgaagaagatgtctcgcaggtcatggcggcgtttcttggccaatactttatcagcagtccggagcgcgacctgccaagcgaattgatcgtcaacgtcgtccacgaagattttccgacactggtcgaggcgattcacgagttgcgtggccgcgaactgaccatcagtcaccgggtgcgcggaacgcgagctcgctggcagcaactggctgtgaccaatgccgagcaggcactgggcgcacgtctggccaaccgtcagtacacggctgcgcgtttcgaggctttggcagaagtgctgaacctggaggaaccgccacaacgcctggagtgttacgacatcagtcattccagcggcgaagcgaccgttgcgtcctgcgtggtgttcggcccggaaggtgcgatcaaatccgattatcgtcgctataacattgaaggtgttacagcaggcgacgattacgctgccatgcaccaggccttgacccgacgcttcagcaagttgaaagacggcgagggcaagttgccggatattttgctggtggacggtggcaaggggcagttgtcgatggcccgcgacgtgcttaacgaactggccgtgccggatctgatcctgctcggcgtggcaaagggtgcgacgcgcaaggctggtttcgaaactctgtatctgaatgatgcagcgcacgagttcaccttgcgcggcgactcgccggcactgcatctgattcagcagatccgcgacgaggctcaccgttttgcaattaccggacaccgcgcgcgtcgtggcaaaacccgccgtacgtcaacgctggaaggcgttgcgggagtagggccgacccgtcgacgcgatttgttgaaacattttggtggattgcaggagctgactcgtgcaagcatcgaagagatcgccaaagccccggggatcagtaaaaagctcgcagagtcgatttatgcaaacctgcatagcgagtagaatgccccttcacctcgtagccagttgtgccgatgaatatccctaatctgattaccgttctacgcgtcctgctcattccgatcttcattttgctgttctatctgccttaccaatggagttacatggcctccgcctcggtgtttgccttcgcggcagcaacggactggctggatggttatctggctcgccgactggagcaaagcacgccgttcggagcgtttctcgatccggttgccgacaagctgatggtcgccgtcgcactggtcctgctggtgcaggaacacggcaatctctggctgacactgccagcggctgtcatcattggtcgcgagatcgtcgtttcggcattgcgtgaatggatggccgaactcggtgcccgtgcacacgttgccgtatcgaacctgggcaaatggaaaaccgctgcgcaaatgctcgcgctggtgatcctgctggccaatccacgggacttcaccttctgggtcattctcggttacgccttgctgatggtctccgccggcctgacgctgtggtcgatggttcagtacctgcgcgctgcctggccgcatctgaagaccgatgttgaaaagaaataaaacttttttgaatcaaggggttgacggagcttcttaattctatagaatgcgcatcaccaagcgggaatagctcagttggtagagcacgaccttgccaaggtcggggtcgcgagttcgagtctcgtttcccgctccaagttaaaacgcgtttgttgttgtgctactgataacagacgttttgaggccgagtagcaaaatggttatgcagtggattgcaaatccacctacgccggttcgattccgacctcggcctccactataaacaagctccgtagatccatgatttacggagcttttttatttccagtgagcagcaagatttagtcttgaaatcagccactgcgaacttgcttcaccgggacgtgatgtatatatttcccgctcggctgtttaagcctgcatcctgccaggatcgcgactcaacagctggaaagagcaacaccgcgctaccgcccgaatggcgaaactggtagacgcatgggacttaaaatcccccgctcgtaagggcgtgccggttcgattccggcttcgggcaccatcttgaatcaagggtttgcgggcgaaagctgatgcaaacccttgtttgtttctggtccgctattttgaagttggtccgcaattcacttggtaggcatgacctttttgccttttcgattgcggatgtactgctctgtcataaccacggtcgtatgcccaagttgatctctggcttgcaagatgtcaccgctggattccgccttatcggtacccgccttggcgcgcaagtcgcgcatctggaactcagctttcggcaccccggccgcctccctggccaagtcaaacctcctgcgcaacatcgccaccgtcattggtgtgccatcctctgtaacgatcagccgcgtcgagcggaccttgtgctctgactttcgggacatgattcgatcaatcaaaatcttcagctcgcctgttatctcgatccgacgctttgccttagtctttccctgcaacacccaaatctgcccgtcacgcacattgcgctcgtccatcagccgggtgtcggtcacccgttgcccggtcagataggcgaggtccatcgcatcttgcaggccaacatctgctttgtcgtgcacgcaattgaacagcgcatcctcgacatacgtgtcccggccagtttccttgttgcccttgatgcccgcgcacgggttggcaagggaggtgtagcccttgtccctcgcgtaattccagattgcgctgagcagcgccttctcgcgatttgcccgcaccggtgcggccttgcgccaagttaggtactggcgaacgtgcaatggctcgatcgtttccagcggagcaggtggatcgtcaaagaacgcgatcaggtttttcagctcgcgcttgttgtcggcctgtgtggcggcgcctttggttgggacgatatcgaccatgtatttttctgcgacgtaacggaacgtgatgaccttggcgaccaggtcggttgcggtgcgatcacgctcaagcttcgcgtattccatgatcgccaggccgtagtcgctgcccagcggaatttccttgcggtccttgccgcccgtgtcgtagtagtaaaacacccggccgctggcttttttgcgttcccgcagcctggcgatcgagccgggtttgcttggtcgtcttcccatgtcagctggccttacgtgatttccatacgggcttttctgattcaaatgcgccgacagcggtgaccgccatcgcggtgacactcggccacccgttcactttaatcgtatggcgaacgccattctttttcaggttgaggatctgccctgccttggtccgcgcgccggtgagctcgcaaacctcctcgtgagatagaaactggatggtcatgtgatgctccatgccgcgcgtggcggcagaaggtggtgatgggttatgcgccggccttggccagagcctcgtcggcaatcttcattgctgtctgggcattgttgacgtaggcagggtcgaagccgccgcacaggtggatggttgcttggcaggcgcgcaggttctcgcggttgagtttcagcgcggcgaccagctcttcgtgcagtccgcgttcctcgcggccgatatcccagaagcgctggccccagtgttctgccggcggcgggttggtgttctgcgcgccgagggccagcgctccgaccacagcgtcgagcaagtcgcgcttgtaggcgttgtcgccgtcgatgctcaggcctttcctgcgcatggcgctcaccgcttcgttcatatcgaactggctatcgacacgcaggaagtcggccctgggattgccaggcttgtaggcgaccaagcagagcttcgaccctggttcaaggtggttgtagatggtgaccattgcggtgttgatgatctcatcggacagttcctgtaaatcgcgcatacgaattcctcgcccgccgttcaccggcaggctcttgtgtgggggaggggttatagagcgagttcgacttgggcttcgcgctgccagatcggcgaactgttgtgcgattcaatgcggtcggcgatcacgcaggcgcgctggccggcggtgggcggggcgtacataccgaagcgactgatgctgccaccgtttaccgcggcgtttgtagagtcggccgaggcaaatggcaggtgttcgaagatggccgggtcgagcatgcggagcccgtgcagccggcacgccggtctgccctggtcatcgcagatggcatccatggcggctgccatccgcttccaccaggctgcagttccaggtgagcgccattgcccggaactgccgaacgcaaccatcggccattcagtggccaacttctgtaagcgctcgagcgattcgtgcaggtgccataccggtacgccgcgcaaagcccgtggccacgctgacaacagcgcatcgttcgccacttcgtcgccatcaatcacgtctgggatgagagcccagtcgaagcccgggtgccggtgccactcttcgacccaccgggtatagccgtccacgtcgagcgtgccgcccttgttccatacgctgaatgcgccgttgtcgaacacgaacgactgacagacttcggcgacgattcccatgtcatcctggcgcgggaagggcaccagtgcgtgtcggcctgcgaggaaccgggcaccgtcctggcgagtgccgccgactggcgttccgtggtaatgaatcatccgctcagtctcaccgtttcgatttccacgccttggtgcgtggcaatgatcgtttggtccccgccgagggcttcggacagccgatcggcgatttgttcgtgccagccttttttgatcagggcagtcgctgccttgatgtgatcgacatgaatcattgcggtggtacgcaactcgaactggtaaacgatggtttcaccgtcagatgggcaggcggcggtgaaagtgtggcggtaggtgtttttggatttgtcttgactaggatgaggagtagccatttacaaactctccgtgagactattgaggttaatgacaactaatgtgcgagtaaagaattgaaagattttaggcaggcttctatttttatagttctggtcgcaatcattggcgtttctggtgtttatttttatgtgtttaatgccgggctttctgatgattcaggaaaatggtcagattttggagggtacattggtggtttgataggtccgctaatttcatttgtcactttgcttgctgttctgcagactgtttatcttcaaaagcaattgctcgatactcagcaggcagaatttaaagatttaatgaagctccagagagatactttcgatgcacaggtacgccaagtaaataatgctatctctatcgctgatcgcgatcacattgagcgcactcgcgaagcttgcctccagatgattgatcgacaaattcttcacactgaaaataagatggcgcgggctgggaagacctttgaacagacctttcagttgaaaaccgaaagcggagagcaggaagcagatatacggaacacgctaaagaatcaaataattatgtacactaacttacttaacgatcttgttggatattcagtaagagtgtctcaagatagctataactctgctgaggatatgttgatttcgtttagagaagagatgcataggatatatgcaaaaaacggccgaggcgatactgaagctgagtcgtgatggctaactttcctttgtcgctatagcggctgactttgaagggggggaggggtggaacgaaagagtgaggcgctaattccagcgaacgtcgagttctgaaatttgttgctgcagctgttctatgagttcaaaccaagaatcgaaaccatttgattcgttctggaccagaaacaggtaataacctccggtttcacctgcgcggtcatcctgaatttctatcgtccaaccggcgtattcgccagtcaaaactgttccagtacgaatgatctgcatgtgttggtcggaatccaatgaatgtatgaaatggcagctgtactttttacatcagcttggaaaatattggtactgcggcattctccctcgctaccagatcatgggcattcacaaccttcatgccgagctcctttccgatatgaacctcaaggctggcgccgcgggaatcctgccagccgggcagggtggccacggtgtcgcattccatcagcgccgcgatgtcgcggcgcatgcatccgctctaggtgcctggttctgggttgagctcggcggggtttacgacactgtgcccagcggcgcgcagggtggcggccgtggaatggaatagcgggaagttgaggtccagcgtgttggtcatgggaccgctgaggtagatgcgcttcatgcgaccaccttcggcgtgtacgtcagcgtgccgtcgaggatcgcatccttgatggcttcgaactcccaggcgtagtactgggattcgacgtagacgcgcatttcgccgtagtcgtgcttcttgcgctggatgaacgcttcggcggcatcgcgagtgaagtggctgttcatgatttcccaacgcttattccagccggtgacggtgtggtcatcacgctcggcgagatattcccactgatcgtcctcgtccagatccataaagctgcactcccgatcagtcatcagtgcctggtcgatctctgcgcgctcctcgtcgtcgaggtcttcccagtattccttcgggctgaaccacgactgatcctctaggcacacgactcgaccctcggcgtagtcgatttcgtagccgtaatcgattcgcttggtctgcacggtgaagatggcggccgcagtgtggtgccatttaccgccggcgccgttgcagtgataacgaaggcgttcgacgaaatcggtccaggtcgaagcatcaagctcggcgccggtcgccaatgtcggcagcggctcggccttttggttttctgtgggcatggtgcgtcctatgccggggcatgcccgggcggtggagggtggtggagggtggtgggggatcagctacagttcatcgatcaaccaaaggagaaggtcatgagctgtttgatatgcgaaggtgaggccgaaataatcccgtctaccggagactacgtagaaagagtgtgtgcgaaatgtggccgttaccgcgtgagcgggaccatcgtttcccagttggaaactttgaaccgaaaattcgacgtagagcagatgaggctttacgtacaacgggaggcggctaagggtgaggttccgttaatcacgagctacgttgctcatctccgttgatctctaagctgcagccttgagcgcttcgagaatccgttgaccagcaagcggcggcacggcgttgccggtcatgtgcatggtcagtttgtgattgtccggccggagcgtgtccttcgggaatgactgagcggccatcgcttcgtcagcgctgatcatccgcatcatgtcgccgtcgacgactgcccatcggtccagcgtggtgatggttccaatcgggcggtccaggctgcgaccggtgaggccagagcctgagccgtagtagggcatgacgaaacgatcgccaaagcgctcgcggccattcttcacccggatcagcgtcgaggtggcgcggcctggcttgttgatcggcgaccattttccggcgtcgaagtcgataatctctcgggccggcacgtgctggtagtggggcaattgcagatgcagtggcgccttgctgcgcgagcagaccatgaacaagcgcacgcggtgctgcgggacgccgagatcggcacagtccacgatgtggggcgccagtgaataacccagccgctgcatcgcgtcagcccatgccgggtacagaatccagtccatgaactccggcacgttctcgatcaccgcaaactccggccggttgacctcggcgttctgcaccggcgcccaagccgtcgagcgcgagttatcgtgctgggggtttccggcagacttgccgcgagccttcgtgtgcccttggcagcatggcgaggcgagcatcacatcgtgcttcggcacgtctgcccagttcgcctggtgcagatcctgacaggcgtggatggtgcccgggttattgcgggtgtgccactcgaccgcttccggccagtggtttgcagcccagagcacatttagcccggcgtccttgccgccgcgcgtccaaccaccgaaaccagaaaacaagtcaattgctgtgagcatgcgggatcctcgccggctggcgtgattcgtagaagtggggtatttgtgttcggcttgaaatttcagaaaggcagagttatgaacggtcttcacgagaagcattacttgctgcaaaacgctgtagaggcattcattacccacacaggaacggagcgagacagggctgagagcgcgatgcgtgagcttgggccgctcaaggctgaggacttcccagaacatcttgaggcatctaatttcggccaggtagaaggtttccggaagcagcttcgctccggcaatatttccgaagagggtttgaaacggcttctttgcaacatttgggcgctttataaatcagtctcggcgtcaagggatgcagccttgcgagattcaacgcaatagttgagggtgggttagggcgtgttgctcgccccacagttccggcagtcttcgcgatagcgctgcgcgtcgcttatgaagcgaccgcaaccatcgcagttgaacatcatcatttttggcctactcgccttgggcaacttgatgccggtgccgcgcagggcttccctgatgtgcacgtcatcgcgttcgaccaaacggcggctatgcgcgtcgatgtagggcttgggccaaaccactgcacctgattgactgagctttccgatccagatcaagctgtgagccctcggtactacggctgccttcgacaagtcgctcgtaaatacaccattttcacaaagccaaatgaggttgttcccgttccagcactgcggcttctggatgtaaaactcggctgcatcggggtgctgctccagcgcttcgctcaaggcgacatcttggcaatcgacaccgactcgcgccctggcgtcgacatagtcctttggccagggaatgtcagtgtcgcggtgatcgcaagcgccgtccttggtgaacacttgggccttggcaaggtcggtgacatacccggagccgccgaagccccagaacgacaacccgtccccaacgtaggcgtggttgcgactgtcttgcaggtagaacacatcgtccatggacttgctccagtcaggcgccgccctccgtgaccggtggtggcaatttggtttgaattcgtgtttgatggtcgaccggcgtggggccgcgcaaggagcatttacgtagtgaaaatttttatcagctggtctggcaatcgtagtagggcggtagctgaagtcctaaatgattggataaagtgcgtcctgcaagcttccgaaccttggatttcaacgcgtcatattgaccgtggctcattatggtttacagaaatcaacgaaaagctaagagatataagtgttggcatcgtttgtttgactcaagagaataaggataaaccttggatattgtttgagtctggtgcattagcaaagggacttagcagtaacagagtttgcacgtttttagtagatttgcagcccggtgatttaactgatcctcttgcccaattcaatcacacaaagccagatagaaatggtgtgtgggagctgattagaacacttaactcctgcctacttgaaaaatcgctagatgagcgtgttctggaaaaagcatttgaggtttattggccaatttttgaagccgagttcgctagcgctcttaatgctaatgaaccggagaagcaagcaaagcctcgggctaaagaagatgtactgatggagatcttgtcggtaacgcgcgatatgagtaagcgcgtaggggcccttgaaagtcatcagcagagctctgctccagcgactcgacttataaagcctacaccatcccgtgtagatatattgaagatgatgcgttcaggtatttccatagctgacgtcgtcaacagtcaaattagacggggtattgaccccaaagtggcggtggatttcgtgaatgaagtgctcatggaaaatgcagctgtattgaaaactcatccagccaaccaagaacatgaagatgtataaagctacacacaatgttccagtaataggctgctcatagcgcgggctcgacgatttcgtcttctggcttgcccggcgttttgtgtagctcgcgcaggctttcattcccaaacatccgcgccacgttttcgctgatctgcactttgtggcgcggactttccatcgcttggaatgacagggtaggcccgagcgcatgagcgttcagaatacggttctgcactgcctcgctcatttcctcgatgccgttccatgccatcagatcatcaagcttctgtcgggtgccgagtctgacccggtgacgcagttccttctagtcgtactcgatccgcttctcggctgccttcgccgatcgctcttgtccagtcttggccatggccaacctcttttatgccactggccggcagcgccagccaggtctgtcgtttgcgttgctggggtctggaacgtctcacgctgcgaccttcacctggtgccaggcgccggcggcgtagaacagcttcgcggcttcggcttcggcttcggtatcgatatcggcgaggcaaccgcagatgacgaagccgaacaggcagcattggtgctcaacctgaaggcgtggaaaacgtacaagttcgcgctgggcaaggtgactgtgcagccgacttggtatgccgcaccggtttggccggctgagcctcctaccccggtaatcgtcgccgcgccagaggagttcggcgccgtttgatgaagtgattcaagcctgcattacgcggcccgccatcgagcgggtatttttttgcctggagaaaattgatgactgcaaccgagaaagagcgcgacgtcctcgcccgcacgctgtggggtgaggctcgcggcgaagggacggccggccagattgccgtggcctggacgatcaaaaaccgcgtgaatgacggcaaggcaaattcgtggtggggggagggctatgccggcgtctgccagaagccctatcagttcagttgctggaacaagaccgacccgaactatcatttcctgatcggcgtgaagcagattccgtttcgtgagctggcgcagtgccggatcgttgctgaccaggtaatcgacggaaaggtgcaggatccaaccggcggtgccacgcattactacgccaccagcatcaaggcgccggcatggtcggcgaaggccaagcagacgctcaagctgggcgggcacgtcttcttcaaggatgtgccgtgatggtcgttccttggaaagcgttaggcgtgctggtgttggttctcgccggcttcggcagcgcctggcagcttcaggactggcgctacggcaaacagttggccgagcaatcccggttgcacgccgaaaccctcaatcaactgaccctcgccagcgccgccgcccaacaggccgagcgggacaagcggctggcgctcgagcaacgactcgcggccagtgacaaaactcacttcgagaaaatgaccaatgcccaaaaagaccaagatcgcctgcgcgatcgccttgccactgctgatgtgcggctgtcagtcctcatcgacgcagccgactctgccaaaggctgcggtctgccaaccaccgccggcgccggcgacgtggatcatgcagccgtacgagccagacttgacccggcgcatgctcaaagaattatcgccatcaccgacaccggagaccgggggttgatcgcgctgcaggcgtgtcaggcattcatcaaagagatagagggtggggaaggtaggttatttcaataatcctgattaattattgtacttcgaacagaccactccgagccaattttataggctactatgcagctttaggttttttctaaaatggtgtgagatgttagaaggatttctaggtgccttagtcggtgctgtggttgcagctgtagcaactatactcgttgctaaatggcagttaaaattagtttcagagaaccacgctcagtcaacggaacagctaaggcgacaacatgaggaatctacgaagttggttgcaaataaccatcgagagtcccttgaagagcaaaatcgtataataaaagagaccttttctcagcagcttcttctccaagctcacgagaagcggattcagcatcaaattgaattcttgagccgccttgagcgagttgtggaagaagacgcctggagtgcatttttgaaggggcatttgctcaggaatggtggcccggaagggcttgatgtacagaaagcccttgaattcgcagtcgaggttagagtttttcaagatgaggtttcgaagactgttcgcagatttgacagaatactagccgagaatgctcatctcgaagagtttagtgaaactcttcgccccactctaaatttccaaggtcgctttaatgaaccgattgcacgacttgttttaactcttgagggatatccacaaaatccatctcaggagattgctggtttcatcagggataagtttcataacttttctcaagccgtagatgaatatgaaaaatggatacaaatatgtcgtgggagctttcaaagcttccgcacccggatttactcaggggaagttgtaaaatagaacgccgaaattttgatcccttccgcgaagttcgaatgagctctcagcgtgaaccaggtggcgccggcttcgtcacaaaacctttcccggcgcaggtcggacagtcgtctcgtgctccaaaacgattgaggcaggcagggcacatgcagaaggcggccgactcgatgtgaggccgcatctttttaaaggcgcgcaaatcccgttcctcctgggcaacctgagccgcatctatgagtgcccgaaaggcatcagcatcagagagagggcggtgcgtgatcccgccgatcattcgttcggtctcgatcagttggtaccggcgcccattcatttccagaactaagcctgaaatcttcccaacctttcgggaaagccccaaggtcagtcgcacaccatccgcgtcggagtagaccttcccgtcgtaggcgaaggaagcgccgcgcggttcgtcgttggcgaacttgaatatcgaccggcttctcgtgcccagcagattcccgttgtcgatctgaacgacgtcgtagatcgaggcgccgcggtagtgctcgggcgagttctgcagctcctcgacggcgtgccagtacgcggcgtctgccatctcgttcatgtcgaactgctcaagccggtcgagcaggccctcgtcgaggagcgtagctgccatctcgtggagggtttcccgatgcccctctgggttttgcatacggaagtcctgatcgtcgagagtcgcgcgccatcgctggagccgtaggttttttgcctggtcgaaattcatgctgaggggttcgctgtacaaatgctgtatgcatgtacagtaatctaggcggggtaggtgggcgagggtgaggcgacgaactgcagcgttgcggctactttcggccaaaagctgacgttcattatcggtagctttcgactattctctggtatacctcactttatgctaatgaaatagatgccataactgatgccttcaatgccgaagatcagctataaacagcaaaaatagcttttaggctggtagttatgaccggtcatattatgatgcggcttttttaagatatctgagcgttacgatgaatcaggcgcactcactgagagcgccgtttgtgctaaacgaaaaatttttaatcgacatatcgaaaaaatttacccgacggcaaacacaacgtaaggtccgtagcacaagctacagcccgaaacaggagacaggatgttagagcgatttcaaggcgaatctggccggaggcttacggttgatgcccttctttcccaacgactggtttcaggaaaccgtgagcttgcggagtatttcgccgacaacgtggagcttcttgaagtagctgtcggtgatgttttgattgagcaaggtggctcagataacgacttgtatctgattctgaccggagcttttgacgttgtcgttaataagcgtcgtgttggtcgccggttttctagtgatcatgtgggcgagatggctgctatagagccgtctcaacccagatcagcgacagtcgtcgccacggaaacgagtgtcgtcgctcgtgtcgcggaaatgcatttttctgaagcaggtcagcgttatcccgaagtctatcgttgcatcgctcgggagctctcaaagcgactttatcaacgtaacgcgcatgtcggcgcagtgcgtgagcgaatcaagatcttcattatctcctctgctgaatcacttggcgtcgcgagagcgattcagaccgctttcggtcacgacgactttattactaccatctggacggatggggttttccgggccacgaactatccgttgcaaagcctattggatgccgttgatgattccgatttcgcggtagctatagcgcatgctgatgacatcgccgcatgccggggccaacaatggcccgtcccccgagataatgttgtgtttgagcttggcctgttcatgggacgactcggcaaagagcgtgcgattctgatggagccgcgcgatctcgatgtcaaattgcctagtgatctctccggcattatgacgattatttatcggtatgcgcctggtggtgacactgcggcgctgatgggacctgcctgtaatcagctccgagatcacattcttcggcttggaccaaacaattaggaataattaatggcattggcggatgatctaaaaaagtgggtcggggaaacgttcacgagtgcatgggatgcccaagaaaccaccggggtgccaaaccccgaagatttacgtttgaattcgaatcatgcgaaagatcttagttcagcgactgttctttacgcagacttggatgggtccaccgatatggtgaacagatacaagtggcagttcagcgcggaaatttacaaggcattccttaaatgcgcatccgacatcataaaaagtgaagggggtgtaatcacagcatatgacggagatcgcgtcatggcggtctttactgggaactcaaaaaatacatctgctgcccgatgcgctttgaaaattcacggtgcagtaatagatatcatcaggcctgctttaaataaaacttacaatacaagttttgttttgaggcacgttgttggtatcgacaccagtcaacttagaacagctcggattggagtgcgtggtgacaacgatttggtatgggtaggtcgagctgcaaactatgcagcaaaactcacaagccttgcagacaaaccaacccgcattacagaaagcgtctatgaaatgttggcagacgaattgaagtatagcaacggccagagcatgtgggctcgggaatactgggaagatatgaaaatttggatgtacacctcaacatggaaatgggcgctgtaaactatcgttgatccgtataaggtcgttatccctcgaagataaagcctgtagaaacataaccaaggagaatctcagatgacaaatgcagtggtatggtttgatcatacctcctcgaaagtatgggcagtagcggattccttacttacggcgcaaactacttctgctgggcagacatccacaagcagagtcacggatcaagcgatgaaaatcctgcgattacgagttggtgcttggggaactctttcacgctctattgtaggcggtccggtgatctgctacgacgtaggccttgtatatgcaggcgcggtgacccctgcgcttatgacttattcagcagcggcgatgatgctgccaaatctacatccccaaaccgtagaagacaggaggatctttactccagacctcaccgctgttgctgacttgatccgacacttatccgaacgttatacgcgcgacgccagtgttggctatagcaataatagagcgccgttttgtgagtttgtaatattcgccatcccgccagacgataagcttaatgatcttcctctggattgctattggattcatccgaaattcagttctagtggggaattttctcaaattgctgagaaggtcgacctacttggcggagaagtggccgttattggtgacgatacggatagtcttcgcgcagacattgatcggttgttggcttgtccagatggcacctataaaggtagggaaccacgagtggcgctggaagaaagaatgcgagctagaatgcatgacactgtaggtggcaccttgcagtttggaatactggagaatgggcgaatgcacttgtatggagcgatgcacgaccaatatggtgagccagttcagaactggcttgggttcgacttcaaggcggagataaattcaatcctcgggatgcaagtgagaataccttccctagactagtatggattcatttgatgggattccatcgctatggtcgacaacggtcgtcggtgataggcaaagtctcgtcatcatctcccttctagctattctaaagcagcgaacgacacccgcccaggatagacaccatgcgcgaccttcgattcagccgtacctttacgctgctacagcaagaggggcacctagccagagcatctttgttgacggggattgacttacttttaaaagcgaatcttgatgaaaggaaaataggtaatttctattcatcgttctttcagctcacaattggaatcgaacgtattttgaagcttgtggtcattgccaatcacatgctcgaaaataactacaaacctccaactgatgctgagctaaaaagcaaatacggacacaatattaaggctacttatctatatgcgctttccgtacgaaataaatgggggcgcaagaaagtcgcacctccgatttctggcagcatagaagataaaattctcgactttctagaaaaattcgctaataaagctcgctattataatctacgcgaactcaacaacactacagctgatcgagggccgctgggagactggtactcaatttgcaaaaaaattgcgaatgttgaaattggtttcggaaaaatcagtaaagattccgagcgcattatgcatcaaatggatgaagcggggattgttggctactctgccacttttgatttcgacggacatccgatgacgctgttcgacgaatactggagaatgcatctaattgagaaaattgcgccacatatggtttttaaagttgtgcaatttatcactccgctgtatgacgccctcagatacatttctttcgaggcaatggactacgaaaataatcatcaactcaaactgccagtgattccacacctgtacgaattttttgttttcgcgcttgcgaccaagccatctgctctgcgtagaaaatcatgggcacggaccttcttagattagctaggcaaaaagggagacaaatttcgtaatgcttaccgtccgcttttggccgattggcgcctgtcgcgaagtgcggttactgacccatgcgagacatcacttcacgggccactggtgtagatgagcagggctatgaatgctgcgaatggagagagcagaatcagcgcgccgacgacaactgcccagccccaggcaaaaccactttctcccttgaagcggccgccgctcaagaggctcagtacgtagacgccaacacgatgagctatcaaatcgaaaatgaagtccatttgaccctcacgcctcctagtcgtgttcctagatatctccgaacgatatttctggccgactattcgtcagtcgggcgtcatcagcactgcaagcgccatcttgatgaactcttcgttcttgtcgatcgcccagagcgcgccgcgcacatcctcggcgacgtcggccgatccgcgttgttcgacccagttcgacagctccatgatggcggctttgagggcaagctgattttcgttgatcttgaagagcagggaagggagcagatctgagttcggcattttggtttcctccgtgaagaaaccagagtagcaggggattcattgtcggcagaacgccggaggagggcaaaccgctgaatcatgcagaatcggcatgctacgagtttacagtagccgataagataagaaattctacgcggatttgagagcttttattcgggccgcaatcgttttacggaatgcggaaacattgggctgtatggcaggtttttgagcttgattgcggcccagaaaacctatcacaacgcgcggcctgattgatttccactcgggacttaaaatcccccgctcgtaagggcgtgccggttcgattccggcttcgggcaccatgaatatcaagggcttgcgtgaggtttctcatgcaggcccttattatttgttttccgcaatttttgagtctgctccgcgacctaattggtcgggctgatttttgtgccgatcctttccagatttaattctcgctcattactgcggaagtccctgagctggtacttggcctgcatgatgtcgccgcttgtttctgcttttgtcagcgccggcccagccacgaagtcttacaaaccttttttctctactcgtgcagcctcgcgcgccgcgtcaaacctccctcgcaaagaagctgaaggaaggcgaaccacaggcgatgcaccaggtttgaaaggattgccattggccgacgctgcgcaaaatcacctaggcgcgattgaggaagcttgtggggactgctgtttgtctgggcgacacaagcccggatcaacaccgccaattactacctggcaacgttgaacatgcaggcgttcttcgggcattttggcgtgcgcggttcgtatttgctgtgggcgttggtggtcggggtaatcgtgtacggcttgatgctcgcagaggggtttgcctacctgctcaaggcgctggcctatcaggggattttcgtcgtagccgtatggtgttgcaatccgccgattatctctgccggggcgaacggtaaaaattgcaaagactgctctatacaggcgccgttgccggattctgtatagagcggagttggctgtatggactatgtatcgaggtagctctcaagtagcttgattcttggaaccatttggcgctcgaaactgaactctcggaggatggcctggcgtccagattggccgagttggtaaagctcctctcgattgtccatgtaatactggaggcgagcgcagatcattgcgtaatcacgattgatgatttccatctcttcaggggcgaaaatacgggagccatcaagattctggttcatgctctggaaatcagtcagtaacattgcaacgccctgcaggcccgcttcgacgacacaggtagtcgggaagccatcaaaggattccgggtaggctggatcaagtgcggaatgttgaatgtttggcgagagtattacatccatggaagcatagaagtccgggaagaacgttgcgggccttgttccgtaaaacgttacgttacgcgcatcgcccagatctattattgtcgcgtcgaacccgccgacgacatggaagttgattgatgggttgttcgagaaagctttaataacatctgcaaaaacgtcatagcccttttctgcaccgatggccgaatagcgctgcgcaacgaagcaaacgttgatggcagaatgattgatagagcgcggcaggggaggcatctctgaatacagttcagggatgattccgccaaaaatatgaactattcgttcgggaccacagaaacccttgtctatcagataccggtaggaggttatctgggtggtgattatttttttaacctttgggttatcacagagacgccgcagcgactcatcggatcgcgggtaattgggggcaaaaccaccccctggatagagagtgaaaacaagatgatcagctgagggcacaccaatctgggtgaagaaaatatcggcaagattcaggaatacgcaataggctaccttggggttgccgatgtgatttctatcgaagcgccggagtctttccttgctgatgtcgtttgctttacagaagtcatcgacctgattcgaaagtgcactctgctcgccaaagctgaacagctttgcgtcggggcgggtctgcacggagctgtctttaatcgacgtcagataggtggaaaactccccatagcgaaaagatgaaattttcgaggggaacgctgaatcaaggagcaagaggcgtgtttctgatggtggcgcagtgtttactgcttttgcgtcaagtatttgatttttggcgcttctgcaaatgctctccagttcgggttgcaagccgtgaagctccgggttcctggcaaattcctgttctgcaaggcttatttcccccgcctcgaacagcaaatctgcgtatatcgcggaaaggacctgcgactcaggaaagaacgacaggagttttgctgtaagcgctttgatctcatcgatgcttattgtgctttcgtaccttatccagcagccaaagaggaacgaggcagcctgttcaaaatatcctgctagagatgtcgctggtgtgctgcctggcaaggcatcactgtacagcgtagccgcggctgaaatccgctcatgggttccgctttccagctctagaatgatatgcagtgtaagcgccatctgatccgatgagttgtgctccagcgcgagagaaactctcttcatcgcatcagcggagcgcaggttcaatgggtaacggccttcaccatgtcctgcatcaatatagtgctgaagcggatcgacccccgccgcctgaatgtccgggtattgtttcaagtagaactctttgtcgagaagcgcctcgcacattaacgcatgggcgttttgcacattgactggcgtttcctcaactcgttcaggagctgtttcgttcgcggttgcgttgattttggcttttttgccggagaaaaaacggaacaatctttccattcgtctaactgtccataaggtttaaagttaacggcggcgtgccaccgttaaaattttgatgctggaaatcttcttgtttccagaaccgcttattggctaacttttgcttccgcagcatttgttgatcctatgcgaccggcaatagttttgccgagggcaataccaggcagctcaacgaaacggtaaaccagatagctaaaggtataggtgagcaatattacgattagccaaattgccagcgtgccggatataagtgaccatcccgatcccttcgccgccatgccgatccgggagccaacgatggcaaggaataggccatggaacagatacactgaataggaaacatctgacataaatgtcacaaccctgctgcggcaaaccgtctctagtacagtcaagtaacgtgctacaggacgatagggcaccagcatgattgcgatcaacgccaccagagcggtgaggtaaagtacttggtatcggtaaatgtcgcccagcttagtgcacattagaagtgccaataacacgtaggcggctctgtgccatttcgatgagttcgatattgatgcggcgcgataaatcaatatgcccgcgacaaatatcggcagtttgaagaacaacatagagggttcaaaaaagaaattggctttgccagcggctaccgcttggtcaaatagccacatgaatgcgtacgagaagagcgccagcgcgattgctgttttccccgtgccaaatcgcttcatcgccaggtaaatgaaaggaaatacgacgtagaattgcatttccagactgagactccagtccggtaaaaacgtcgagaaagaataggtgggaaaaagaccgaatagaaacgagatgtgaagcagcagattgccaatggtgtaatttgttcttgctggatcataaacccaatcaccttgccagagggaggggttcaattcgcgcagatgtgtataaccaccaagataaattggcgcgagggcgacgactagaaacagacaaagataatacgcaggggccaatcggaaataacgacgcacgtaaaaccgtagccagttggcagggtttgacatcggctcggtcgtttcacgagcctgaacggtataagccatcagtagtccggacaaaaccatgaagaggtcaacagcaattttgggtgctggaaccgacatctccaaccatgaaccgccccaaatgaaacagtgtccggtgactacccaaaaagccgcgaaggctcggataccgttcaaaaaagaggtgtctctattcatttttgcaactttccatccagcgcgggttaagcgttaatcttaacacgatgccactgtctgatttttagtcccgcccgtcgtgggatacttctttgcagaaacagctgatcagagcatctgaacctcaagccaatcccccgcgtcagaccaacaactccaaggtatcaaacaacctgacatcctccgcccgcgccgaacgcgcacaccggcggatcacttggatcagacattcgacaaaacactgcgccgccacgcccaactacacgttgcgggtggtcacgatacaacgaatcggttttttgtcgaacataggctccatcctctgcgacccgatgtatgcgcttggggctccaatcttgccgaccatgcttgagtcaccacgtcagaacggtcgttttgccttgaatcacgtagcgctcctgagcctctttatactcaactcgccgttttcgacttgatcgaagacagacaatttgaaggtcagcgtgtatccgcgctgactgcgcctttttgctgattccagtacgtcctcctgaaaaaagatcagaagctgtaaacctgattccggacgggacactgagaataaaaaaggggccgaaacattcgaccccttttttgtgcgtcaaacgaagcgttgttgagcaaagccgcgcggtaaacgctggcggccgcccattgcagtgagacgttcctgccactcggtacgccagttcaccaggctgtggctggtgttggtctggcgcgacgctcggcgtgccgcattacgttgatccttgcgggcttgtttatacgcatcggtattgcggcagctgcggcacttgacgcgattgagttcgcggctcgccgtgaggtgttggcccttgtgaccacaggccagatgtccatctacattgaaatgaataaccatcagacgcctccttcgtgacgtgtatctttttcgaccacgcacgacagcaggtgttcatcaaaatgaaacaccggtagaacacccgcaagtaactctggcgcgtgaaagcgcttacctgaaccgtggcagcggtcgatcgacaggcttgagcgccgacagcgtattgcggatcaatggtgcgtctttctcgatgtcgttcagacgatcgcggatgcgcagggcggtcgggtgcccgccttggtgatcgacccagtcggcgatctctttgcaagcagccgcgaggcgtgcctgccgggcgtcgagcagggtgaggagggtggtgatggactctttttcggacatgaaacacctccgtttttacgaaacctgagctgcagcaaaaagcccgcgagtcgcgagccttctgccgttggggcgctgctccgtcagctggtttgagtatagacccgcttttgctcggcatcagccggaggactggcgggccggtagtggcgaactgactttgttgaggcgctggcattcgcgctgggcatcctcttgcgcgtcatagccgtcaccgatgaacccgccggtacgcgtgtcgcagatgcggaaccagccaagggcttcggcaggatcatgctggctttctccggcacgtcgaccgtgaatgatgatcttgttgcaacgcttcacgacgaaaatgtcttccatggcgtcaccgcagctgattcgtgtcagatcaactatagaaggccgcggcaatcgtgcaaaaaatacacagttcagctcgtcggttgccactgccaaccagtggggtgccaactcaggacatggctgggattcaacgccttcagaaatgccgggtcgtgggaaaccgcgacaattgcccctggaaaagtctgcaaggcgtgttcgaacgcttccacagacctcaggtcgaggtgattgctcggctcatcaagcaacagcaattgcgctggcacctggctccacaacgccagtgcaagcgccgctttcaggcgttcgccgccactcagtgacgcgcagggcaaagttgcccgccgtgcatccagttgcaggtgcgcgaggtagctgcgcaaggtgccttcgtctaacggcgtccgttgcgcctgcaactgctcgacaattgcagttcgtccatcgagcaggcgcaattgctgatcgagaaaggccaaaggcacatgggtgacgcattcgccgctcgccgggcgcagttcgccggcgagcattcgcaacaggctcgatttgccgcagccgttcggcccgctgacggcaatgcgcattggcccatgaagggcaaggttcaggcgggctgtcggtgcgtcgacaggtaaccacggcagacaggcatcgatcaacgtgcagacctgtcgggtactcggtaccgcgcttcctggcaggttaatcagcacgccttcctcgggcaggactttcgcgtaggcctcgcgaacgcgcgcgtcgagatcggatttgcgtgcttgatggccgacttttacctgccccatgatctctttcgcggcggctttcagcgccgctcgttcgaagccggaaacgttagcggtgtcggcgttacgccgactgccggcagcgtggcgctggatcgtgtcgtgttcgcgttgcagccgtgatcgctcacgctggcgctcgttgcgcgcctgatcaagctgagcctgcgccgcggcttgatggattcgacgctgctcgacgaattgggtatagccgccgctgaaaacgttcgcgcccaacggcgtgagttcgacgatgcgctgcatccgctcgagcagctgccggtcatggctgacgataatcaagccgccacgccattgttcaagcctgcgcatcagccattcgcgaccgctgctgtcgaggtgattgctcggctcatcgagcaccagcaattgtgcgtcgctcaccagcgcgccgatcagggcgactttcgcctgttggccgccgctgaggcgctccgtcagatcggtggttgcgatatcgccgaggccggcttcgtcgagactgttgcgcaggcggtccggcagatcccagcgctctgcggcaaggtcgaaatcggcagccgaggcccgaccttcatttatcctttgcagtgctgccagtaccgtggcgctgcctgtcgcctcggcaacggtctgccctggttgggcgatgaacgattgtgcaacgtaatgcacggttgcacagcgtgtgaccgtgccggcagtagggcgcaaatatccggcaatcaggcgtgcgagcacgcttttgccgacaccgttgcggccaacgatagcggttggcagttgatcgaacttcagattcagggcgtcgaaaatcatcccgccattggcaaaatgaaagctcgattgattcagggagacgagtgcgcgcgtacgcgagacgtgagtcatcggcacctccaaaaaatctcgttaaaacagacacgcgccaaaaaaggcgtgtcgcgagggcatttttagaaggctgggttgttcacgtctgcggtcgtcctgaagagaggaagatggctagcctagagaacgttacagcgataatcaaggcgcgcccgtcatctcgctcatctgttcgagaaacatcgccagcgctacttcctcggctcgcagccctttgcgcatacgtggtcgcggcagatcggcaagggcgccgagcatgaatttttccaccacggcagggtggatatagcacttgcgacacaccgccggcgtgttgcccaactgtttggccacacctttgaccatctcgacgacatggcgcttggcttcggtttccgtttcgtgagtcagcttgcgtagcaccgccaaagccagtgcactgcccgcccaggtgcgatagtccttggcggtaaagtcggcgccggtcagggtttgcaggtaggtgttgacgtcggatgagctgaccgtgtgccgttgaccattttcatcgaggtactggaacaggttctgcccgggaatttccaggcaacgcttgatgatccgcgccagacgccgatccttgacggtgatctgatgttcgatgccgctcttgccccggaactggaagaggatcgcgctgccgttgatctcgacatggcggctgcgcaacgtagtcaggccataggagcggttatcccgggcgtactgtgtgttgccgacccgaatcaacgtggcgtcgagcaacgtgatcaccgtggccatgaccttgtcccggctgaaaccgggtgcggccaacagtgtttccagctgtttgcgcagtttcggcaacgccacaccaaattcgcgcaggcgcgaatacttgtcagcatcgcgcacttcgcgccagcgcgggtgatagcgatattgcttgcggccccgggcgtcgcggccggtggcttgcagatgaccgcgcgggtcggggcagatccacacatcggtataggccggcggcacggccagggcgttgatgcgtgcgatttcatcgggagcgatgatgcgctggcccgacggcgtgaaatagctgaacttgccgcgcagcttcttgcgtgtaatgccgggctggatgtcatcgacataatgcaggtcggatggcagtgcgtcattcagcgcggtgtcgggcatggcggcttccttcggtggcgcggcggtctgtagaacgattgaccgcgcgcggtggccgtcgtgccgaatgatttaggcgaggacggcgacggccttgatctgcgcccagagctgctgccctggatgcacgcctaactgatcccgcgaaaaccgcgtgatccgtgccagcagcggcgtaccggcagcgtcgagacgaatcagcacatgcgcagcgttgtcggcggcctgctcgctgaccaccgtcaccggcagacgattgaggatgctgctgaactcatcgttgtgcagcgcgaggctgatgtcccgcgcatgtactttgcagcgcaaggcctgccccaatgccatcggtgcgtgtgtcactcgtatggctatttcggtggccggcagttgcaggctgagcaattgataatcggcatcgtagccgctgacctgaccttcaatgatcaccccggcgtcgtcgcccagcgccatcggcaagtccaggcgtgccagagtttcgccgatcggtccgctggccaatgccttgccttcgctgagcagcaccaggtagtcggcgagccgtgcgacttcgtcctgcgcatggctgacgtacagcagaggaatatccagttcgtcatgcaggcgttgcaggtacggcaggatttcgtttttacgctggctgtcgagcgcggccagcggttcatccatcagcagcagtttcgggctggtcaacaaggcgcgggcgatgccgacacgttggcgttcgccgccggacaggtgctgcggatgacgctccagcagatgcccgatgccgagcagttcggtggcctgtgccatgtcgacccggcgttgagacctggcgatgcgcttgagaccgaattgcagattggccagcactgacagatgcgcaaacaggctggcttcttgaaacacatacccgatggcgcgcttgtgcggtggtacgaacaggccgttgtcgctgtcctgccagacttcgtcgttgatctgcacgaagcctcgttcggcgcgctccagcccggcgatacagcgcaggcaagtggttttgcccgaaccggaatgaccgaacagcgcgctgacaccgcgtcccggcaaatgcagatcgacgtcgaggctgaagcctgagtaggcgagttgcaaacgtgcatcaatcatcgatcagctccagcctgtgcgggtcttgcggctggagtacaacgccagcaatacgaggaacgagaacaccagcatcgctccggcgagccagtgggcctgagcgtattccatcgcttcgacatggtcgtagatctgcaccgagaccacgcgggtcttatcgggaatgttgccgccgatcatcagtaccacgccgaattcaccgacggtgtgcgcgaacccgaggatcgccgcggtgacaaaaccgggacgcgccagcggcacaatcacgctgaaaaaagtgtcccaaggattggcacgcagtgttgcggccacttccagtgggcgggtgccgatcgccgagaacgcgttttgcaacggttgcaccacgaacggcatggagtaaataaccgaaccgatcaccagcccagtgaagctgaacgtcagcgtgcccagccccagccattgtgtgaactgaccgagaaagccgtgcgggcccatcatcagcaacagatagaaaccgatcacggtgggtggcagcacgaggggcagggcgacgatcgccccgatcgggccgcgcaaccacgaacggctgcgcgacaaccacagggcaatcggagtgccgacaaccagcaggatgacagtggtcagggacgccagtttcagggtcagccagatcgccgcgaaatcggcactcgtcagcgacattttaaagctggtagccgtaagacttgatcaccgcagcggctttcgggcctttgaggtattcaaccagtgccttggcggcagcattgtccttgcctttgttgaggatcacagcgtcctgtttgatcgggtcgtgcatgctggcaggcacgatccacgccgaaccgctggtgactttgccgtccttgaaaatctgcgacagggcgacgaagcctagctcggcgttgccggtagacacgaactggtacgcctgagtgatgttctgaccttcaacgatcttggttttggtcgcttcggtcagcttgagcttttccagtacctgggtggcggccaggccatagggtgcggctttcgggttggcgatggacaggtgttggtattcgttcttcttcaacacctcgcctttagagtcgacataaccttctttggccgaccacagtgccagggtgccgatggcgtaggtgaagcgcgagcctttaacggtatcgccttctttttcaagtttttccggggtcgtgtcgtcagccgagaggaacacttcgaacggtgcgccgttcttgatctgagtgtagaactggccagtggcgccataggctgcgaccagtttatgcccagtgtctttttcgaaatcggccgcgatcgcctggatcggtgcggtgaagttggcggcaacagctacctgtacttcatccgcctgagcagcactggcggcgaagaccgcgagcaaggaaaccaggccggcaggggcaaaacgagagacacgaatggtcatggaacagctccgtggttggcgagtgcatagggcagctattgttggaagtggactgcgccgatgcgaggggtaagttcgctatataaataaatatatagcgaaatgccgccaaacaggaagtgctgattaaagccagagtggggggggcgctcgactccccgctcaactcgacattactggcgtgtgagtttcgccagtgcgtcttgtgccaattgccgggtcaattgcgcgctgtccaagtcccggcccaaagtgaatgcctgaccggcccagaggttggcaaactctgcttcgttgatcgctctcaatggcatcaacgcaccgccggccaaaggaaatgccggcgcctttggcgacatcgggccgagctcacgcatgacccggttgagaatgccacgcgccggacgtccggtgaatagattggtgatcgcggtttcgctttccttggccgtgcgcagcgccttgtggtgcgaggcgctgactttcgcttccggtgtgaacagatacgcggtaccgacctgtaccgctgacgcccccaatacgaacgctgccgccgcgccgcgagcatcggcaatggctccggcggcaatcaccggtacgttcaccgcatcgaccacctgaggtaccaaggcaaacgtaccgacctgactgctcaggtcatcactgagaaacatgccgcgatggccacccgcctcataccccatggcaatgatcgcgtcgcagccgttctgttccagccagattgcttcatcgacagtggtggccgaggaaagaatttttgccccggttgccttgactcgattgagcagggattgctctggcagaccgaagtggaaactcacaacctcaggtcgaaattcttccagcacttcgcacgctgccgcatcgaacggcgcgcgattggacaccggcgtcggtgcgtcgaaatcggcatgcagttcgcggtaatagggctccagcagatgcttccattcacgtgcgcgttgctcatccgccgccggtggctgatggcagaagaagttcacgttaaagggcttgtcggtgtgttggcggatggttttcagctcgtcgcgcaattgctcgatgctcagcattgctgcgggcattgaacccaagccaccggcattgcacacggcgataaccatggacgaattcgtcgcgccggccatcgggccctggatgatcggcagttcgataccaagcagatcaagaatgcgcgtgtctggccattggctcatgaaggctgttctccgaacggtgaaaggcagagccggttttttaacagtaaaagcggatcagcagccagtgcgaaattcagaacaacccatgcagtttttcagcgtcggtgaaacccgccgccaccgccgccaaacgagtggttcatgaattgcgaggagttgtggaaattgttggtccgttggttgccgaagttgcgcgccgcagagtcgcggttgaggttctgcaattgcgcattgttgttgatgggtgcgctgcgggtcgcgccgccgccaaccatcgactgccagccgttgtcggtctttttatacacgttgccatcgtggcctgcgtaaacgttgtcgccaacacgtgcagcgccgccgttgcgtgcgcgaatgccgccatattgggtggtgttgccagtgttggggttatacacggcgccacgattggcggtgacctgcgtgccgttgcgcgcattgccggcggtgacccgttcgccggcaattgcgccaccgttcggtccgaccgccacgccactgcgtccagcggcgtaattgccgttgtagacattgtggactgcgccgcgttgaccggcagccgcgacgccggtgcgtgagttgtaggaagcgccgacctgtccggcccagcgattgccggtccaggcgttgtaaccggcgccgtagcggctgactgtggcccggtcgccccactgatgataaatgttgccggtggttccggcccagccaccgggcccccaggctaccgcgccgccgtgataaccgtaagcggcgccgccccaggccaaaggtgctggatacaagtgcggcccccaggcgtagccccagccgtaattgccccaccacggataggcgccccagccccagcccatcgcgacagtgctgccgccccagctccagccgaagccgaaaccgaaggtccagccggtccagggggtatagcggatggcgacaccaaaaccgtaggtgactggcggaccgtaccagacactgccgacccacggcgtatagggatatccggtgccgtagaccacgacgcctgtcgcaggatcgaggtttgatccctggtagcccggcgtataaccgacgacgacggtatcgccgctggactcatagactttgacgtaagtgaggtaatgcatcggcgagttcggcgggatcgaatagatcaccgccggcaccgaactggccacggtccacgggccattcaccattgttgctgtgaaccagacaccgttttccaccgcccaccaactgttgttgtcgacccggatgatcggcgtggcgctgttggccacatactgcagcggcgtactgtcgatcgccttgagttgtggttcgccgtcgaactgtggcgcagtcattttcaccgcgcttttcttgattgccgaggtctgtggaatggttgcggcaatcgccgcttccttggcttgaggggtgccggcaacggaagccttgacgttctctttcgcgctgtcatcggggatgttggcgaaatctgccggcagcttgtctgcgggggcaaacgtccacgggccgttcatgtcactggcgcgaaaccagcgaccggaaatcagcacgtagctgttctggtcgccgatctccttgaaaatgtgcccggtggtattgctcacgtacaacaggcctgtgccttgaatgggcagccactgcggcgcgccatcggtgaccagcaactcggtgggcgtcgtggcgacaacgatcctcggctgtggcggcttagcgaggctgggaatcttgtctttcggatcgctctgcccggtcagcagatcgacttgtcggctcttgatggcggcctgcttggctttctccaggtcggcaggcggcgagggcaggcgcgtgtaatcaccgttcaactggtcagcgaccatccagccatcgaagacatgcaggtagtgcttgccctgttcatccttcaacaataacgggcgagtattgattacacgttgcagcgaggtgccttctacagggcgatacgcggcgtcgccatcgatatagacgagcagtgccggaacctcggaactgatgatggtcggcggcgtgttttccagtggtgcgctgtcggctttccgttcggccgagagcacgccgacagcagcttccagttgatcgagtgaaatggttttcttgcggctttcggcatctttttgcagcgctgcgagccaggtgtcggcctgactggcatcggctggaaaatctgccttgatgattttgtattgatcgagagcgacccagcgtgtggccttgtcgaccagggtgtgcgcgctgaaccggacgatgccgtaagtggacttgccatcattgccggtggcttcgactgccgcgcgggcgttgagggtgtagccatcccaactgtcgagttgtggttgatagaccgtcagtctggccttgtcgccggtaatgacctgcggccacgacggcaccattggcgcggcttgcggctgcgtagcgttggggaccgcccacgcgttgccgaaggccggcaggcagaggatcaacatcacgaacaacgaacgcgggcaagacatcgtcagctccatcgacaggccggtctcaaaacaaatgacggcgaaattacgaccgtcgaaaaagcatagccgcccgccatggaaatacctggcggattcatggattggcggaaagtcgagtgtggcaacgtgttgcgatgtggtatttcaaggggcgagatcttgaaaccagccaagagaggccgtcatgttcaacgccattctgatcgacaaagacgacagcggttatcgcgccaacctgcaacaggtcaacgatgatcaattgcccgaaggcgatgttaccgtgcgcgtcgcttacagcacgctgaatttcaaggatggcttggcaattacgggcaacagcccggtggtgcgaaagtttccgatggtgccggggatcgacctggcggggactgtcgaagccagttcccacgccgactataaagtcgccgatcaggtgctgctcaatggctggggtgtcggcgaaaatcactggggcggtctggcgcagaaggcgcggctcaatggcgattggttgatcccattgcccaaagcttttactgcggcgcaagccatggccattggtacggccggttatacggcgatgctgtgtattctggcgcttgagcgcaacggcgtgacgccagagcagggtgaagtgttggtaacgggggccaatggcggtgttggcagttttgccatcgcactgctgaataaacttggctatcgaattgtcgcgtctaccgggcgcgtctccgagcacgagtatctcaagcaactgggcgccggcgaaatcatcgatcgtgcaacgttgtcagcgcctggcaagcccttggccaaggaacgctgggcagcggtgatcgattcggtcggcagtcacaccttggccaatgcctgcgccagcactcgctccgaaggcaccgtcgccgcttgtggtctggcgcaaggcatggatttcccggcttcggtggcgccgttcattttgcgtggcgtgaccctggccggtatcaacagcgtgacgcaacccaaggcacgccgtgtgcaagcatgggagcgtttggccagggatctggatttctccttgctggcattgatcagtcatgaaatcggcctgagtgaggccattgacgtagcgccgaagttgctcgccggacagcttcgcgggcgggttgtggtggacgtcaatcgctgaccctgtaagcgtcggccccgagtcagtagcgctctacatcggcgtccatcaggccagcgtctcgcgctcaagcaacaggcgtttgcgttcgacgccccagcgataacccgagagattgccatcgctgcgcacgacacgatggcacgggatcgctactgccagacgattggcgccgcaagcctgggccacggcgcgcatggaagtgggggcgccgatacgttgggcaatgtcagcgtaactggccgtgctgcctgccgggatttcgcgcaacgcttgccagacgcgttcctgaaaagccgtgcctctgacgtccaggggcaaatccaggccaatcgccggcgcttctataaatcccacgaccttggcgatcagttgctcaaagccgctatcggcaccgatgaggttggctttgcgaaattgatcctgcagatcacagaccagttggtgcgggtcgtcacccaacagaatcgcgcagacgccacgttggctttgcgccaccagaatcgccccgagcgagcattgcccaacggcaaaacgaatgtcgttgttctgcccggccgcgcggaaatcgccgggcttcatgcctagcacttgatcggctgattcatagaaacggctgttggagttgaaaccggcatcgtacagcgcgtcggtgaccgaaccaccgtctgccaggcgctcccgcacccgacgcgaacgatgggcggcggcatagccttttggggtcaggccggtagcggctttgaaaacccgatgaaaatggaaagggctcaagccggcggtctcggcaagttcattcagcgccggaggcgtgtcggcgacttcaatctgccgacaggctgtcgccactgtggcggcatgttgcgcgctgacgtcggttcggtccttgctggcgcgtttgctcggccgatagcctgccgcttcggcctgctcggcgctctcgaaaaattcgacattctgcggtttcggcaaccgcgcaaggctgctcgggcggcaatagatgccggtggttttcaccgcatagacaaacagcccgtctgctcgtggatcacgcgcaaccacggcgatccagcgtggatcggtttcgatgtcgagaggaggtgcaagcgttttcatgtgggttgatccgttgacctgtttgattcaggttaaccagagccagcaagcgcaacactccgggccttgcggtcaaattttggctgtttcgcccgctacgcgaaaggtcaggttgatccgttgttcacccagacgtgaatggtgaccgtgcttgatcggcaagacgccatgaaagcgcagccgatcaacgccgccccagatcaccatgtcgccatgcaacagcgcgatccgttggcttttgtcactgcgattgaaaccaccgaacagaaacattgccggtaacccgagtgacagcgaaacaatcggtgccgcgtaggatttttcgtctttgtcctgatgcaatgacatcttggcgccgggaacatattggttgatcaggcaggaatctgccgtgaaatctgcaaaccccgctcgcgctgccgccgaatgtgccagatcggcaaacaccgctggcatcgccggccatggcaagccgctgagcggatcggcgctggaatagcgataaccgctgcgatcggtgatccagcccaatgctccgcaactgctggtgcccaccgacatgctgaagccgccgggcgtaagcatgtgccgcaaaggggccgcaagtagaatcccgtccagctccttcagcagttgatcgatgaccggcagggcaaaaccgcgaagcagccatgactgttcgccaatttgttcggcgcgtggatgctgttcgggttcgtggtcggcgaacaaatcgaaattgctcggttgcatgaaggtcatgacgcgtcgtgaagttgatacctagggtatgccgtttccactgtgcaggcgaatgacaccgtgacgtacggtcacccgaaacgcgagggcagtgcgcaagacaggcgtgctactggtgttggcaggggcagcgcaagtatgtgtactcgccacgaccgaaaccgtggcgggccatgatcacctgcgcgcaaaacggttcggtctgcagcagcgaacggaggatcgcaccgccgccctgatccagtcgctgcacaaggcttgccctgtcgagcgattcctgtcgggaagatgacatcgacatgctgactccttgactcatggccgaagaacgtcagtccaggcagggccctgccgcagaacactccaccgcttgcggtgaaattcctgtcgatgcttacagcgctttgctgacggcgatgtcgctgatcaagtcttcctggtcatgaagcttgtccagttcagccttggcttcctcttcggtgccgttttccaactgagcgaactcaaaacggcgttcaccgttgagtttgtatttaatgacgtacttggtcgtttgggccacggtcatgctttccttgtttgggcagagcgtttcagctgagtttggtgctggagcggcggatgatcttgatcgagtgggtcagggtcggtttgcgcgtgacgctgatcggccgacggttgacggtgtcgatggtaatgttccagaaaccggtgctcggcgctgtgattcgggccgggaaggtgtcaaaggcgccgccgtgataggtgtgacgaccgccgtttttgaagctgcggaagttggcgtcgttcatcagacggatgttgcacatttgcgagcattggatgacgacgatgtcgtcttcattgaggtgctcgcgctggtgaataaatttcatgggcgcctccagaagggctttttctacaaaatcaaaacgatagcttgtcgatgagcgcagtttatcagcctgcacgggttattatctggccgtcgggcgttggtttgacaattttgaacagatattcgcagtcggatgcgggttaaatgcagaaggccccggagaaaaacggcatttgtgctgtcggacggtctttaacggaggttttgtatgaagtggggtgtggtgtgtgtgccgttggttttggctatggccggttgtgcgaatgtttccgaaatcaacgaaacattgccgaccatgagcgtgatctccggcaagaagccccatgaatatgctcagtgcctggcagaaaaactcgcggacagccgtggcgcattgcaggtgcaaccgcacaaggatggcgttcaagtgatcgttccggggaaattgtcctcaggccctgccgccgtatttgatatcgaagaccgctccggcggcagcagcatcaaattgcatgaacgcatgtcgaatgtgccggtgcgtccccgcgacgtgcaaaaggcggccaatgcgtgtatttccggctgatagactgacagtcatcagcaccaatgccgtcgcagtcttgctgtgacggcattttcatttctggagtcgcgatgaagcgagagcaagtacgggaacgccacgcagagggcctgatctctgccacccatgttatccagaacccggcgaatccgggcgagtggatcgtgtttttcaagaaaagcgccgggcgcagttatttcctggtggatgacaacgatgaggtcgaatctttcggccggctcgacgatttgatcgaagtggtgcgcggcctcgggatcaagttcgccgaaattcacatgtaaggctcacttgcagaccaccaccacgctgcggtttttgtagttgccgacgtcgacacccaaggtcttgtcgctttccttgggttgaggcgtaccgtcagtgccaacgatgcgataaccggtgcccgcgcatgaagcatccgctttttcgtagcaggtggcccaggagttggcctcgccggagcaatcgatggacaggccctgttcgccattattcagatacgtggtttcggacgtggcgcagccgctcagcgtcaataccgcaagaaggggcagcaatctgttcatattcatggtatgtcgtcttcagcatgggggtctagacgctctgacagcgccggtgtgaaaaggttatagcgattggccacttgtttgcacgcgggtacaaaaaagccctgcgcaagggcagggcttggggcatgttgcagtcgatcagtcctgatctttgccacgacgctttgccgatgcaggcgtgtcggtgaacaccgacgccacatcagtcgccatctgctcgctgtcgaagggaccggcgatgtgttcgccgttggtcgtggtcagcgtccacttgccgtccttcttgtcgatcacatacccgttgacgatttttaccgcggccatctatctgtctcgttcgctggttcaaaggcgccatgataccggcaaatgctcgcattgggggcgatgcgcgtatggtggtcgagttgatcggcatctttgggctaagctgagttcgctgcctgaagacgtcaacggaactatcggcgagaatatttctctatgatggcatcggttagccagtgcggggcattgtaaggtgcacgccgcctgattagactgcgccgaaactcgtacacacagccttttcaaggacttatatgatcaagaaatgcttgttcccagcagccggttacggtactcgcttcctgccagcgactaaagccatgcccaaagaaatgctgccggtggtaaacaagccactgatccagtacggcgttgaagaagctctggatgctggcctgacggaaatctccatcgtcaccggtcgtggcaagcgcgctctggaagaccacttcgacatcagctacgagttggaaaaccagatcaaaggcaccgacaaagagaaatatctggtcggtatccgcaaactgctcgacgagtgctcgttctcctacacccgtcagaccgaaatgaaaggtctgggccacgcgatcctgaccggtcgcccgctgatcggtgacgaaccgttcgccgtggtcctggcggacgacctgtgcgtcaacctcgacggcgacggcgtactgacccagatggtcaagctgtacaaacagttccgctgctcgatcatcgccatccaggaagtcgatccgcaggaaaccagcaagtacggcgtgattgccggcgagatgatccgcgacgacatctatcgcgtgcacagcatggtcgagaagccaaagccggaagacgcgccgtcgaacctggcaatcatcggtcgttacatcctgaccccggacatcttcgacctgatcgaacaaaccgagccaggcaagggcggcgaaatccagatcaccgatgcgctgatgaaacaagcccagaacggctgcgtcatggcctacaagttcaaaggcaagcgtttcgactgcggtggcgctgaaggctacatcgaagcgaccaacttctgcttcgagaacttctacaagactggcaaggcttactaagagcgcttgatttgtctgtaagaaaaacccgcttcggcgggttttttcattttgcgccccatatgattggcagtgcttgcccaacgagcatctgcaggtatgctgatcccctgccgaggagatagaaatggcctacgattttgacctttatgtgattggtgccggttccggcggtgtgcgcgctgcgcgttttgcggccgggttcggtgcgaaagtggcggtggcggagagccgttatctgggcgggacctgtgtcaacgttggctgcgtgccgaaaaagctgctggtgtacggcgcgcatttcgccgaagactttgagcaggcgtccggttttggctggagtctgggtgaggcgaatttcgactgggcgaccctgatcgccaacaaggatcgcgagatcaatcgcctcaacggtatttatcgcaatcttctggtcaacagcggtgtgaccctgcacgaggcgcacgcgaagatcgttggcccgcacgaggttgaagtgaacggccagcgctacaccgcgaaaaacattctgatcgcgaccggtggctggccgcagattccggagattcccgggcgcgagcatgcgatcggttccaatgaggcgttctttctcaaggagctgccaaagcgtgtgttggtggttggcggcggttacatcgccgttgagttcgccgggattttccatggcctcggcgcaaacactacgctgttgtatcgcggcgatctgttcctgcgcggtttcgacggttcggtacgcaagcatttgcaggaagagctgaccaagcgtggtctggatttgcaattcaatgctgacatcgcgcgtatcgacaagcaggctgacggtagtttgaaagccacgcttaaagatggtcgcgagctggaagcggattgcattttctatgcaaccggccggcgtccgatgctggacaatcttggcctggaaaacaccgatgtgcagctcaccgacaaaggcttcatcaaagtcgacgagcagtaccagaccagcgagccatcgattctggcgctgggcgatgtcattggtcgtgtgcaactgacgccagtggcattggctgaaggcatggccgtggcgcgtcgtctgttcaaacctgagcaataccgtccggtggattacaagatgatcccgacggcggtgttcagcctgccgaacatcggcacggtcggtttgaccgaggaagaggcgcgcgaggcgggccacgatgtggtgatctttgaaagccgtttccgaccgatgaagctgaccctgaccgagtgccaggagaaaaccctgatgaaactggtggtcgacggcaagaccgacaaagtcctcggctgccatatggtcggtccggacgctggcgagatcgttcagggtttggcgattgccttgaaggctggcgcgaccaagcgtgacttcgacgacacgatcggggtgcacccgacggccgccgaagagtttgtcaccatgcgtacgccggtcggcgcttaagcgtctttcgctttgctggtgtctggcgctgctgcaacggtagctgccaggcgctggctttcctccaggctcgtctgagccttattcaattccttttccaatgactggttgagcagtgtctgctcctcgacgctctgtttgagtgcctggctttccagtgtcgcaacgcgcaggcgttcctggaggagggtgcgttcgctgtcaacgcgggccgcttgctccagcagttgatcctgacgctgattgctctgtttgagttggtcctgcatcaggctcagctcacgctgcgtgccacggttttccgtgagcaggcgttcgttgtcgcggtgcagttgcgtgatctcgtcctgacggatcagcgcactttgctgtgcctgacgcagttcggcctgaatctgctgcacttgcgcttcgtgacggctctgttcctgttcgcgctgttctttggtggcgttgcggtagtgctccagtgcgtcacgggcgtgcaggtgtttttcttccagcgagcggatctgctcgtccttgtcttgcaggcgcaactcaaaatcggccagcgcctgattcaggcccgcgttgcgggtctgttcggtttgcagcatcgagcgcgtgttgccaagcgcttcggactcgcgctccagcgcggcgccttgaatgtcgtgttcttgctcgagcttttccagagcctggcgggtctgtttaagctccgactccagcgcctcgcgctgctcctcgaactgctcgcgggcctgctcgataggctcttgcgcctgttctttgaggcgttgggcgaggcgcgagacgagggcgctcaactcgtcatcgatgggctctgacgacgcttcaacgggctgtgcgccgtcgtccagctctttcaggtaacgatggatcgtggttttcgagccggtgttgcccatttcaatgcgtactgcatcgatgctcgggtgttcgccacgggcgaggatcgctgtgcgcgcgatctgcaccagtgctttggtaatgccgccacgggccatgtgaactcctacggttacgtactgtggtacatgccactaaagtacgcagtgtaccatccagaaaataaaggtaaacctttgataaaaaagacgcgggatatactggtattacccagtgtcaggcggcaaaatgcgtttctgcatccctgtctcagtacgccagcgagaaaacagcccatgagcgatctggatcgctatctgcaagccgccacgcgcgataacacccgccgcagctatcgcgcagccattgaacattttgaagtgaagtggggcgggtttctgccggccacggctgacagcgtggcgcgatatctggtggctcacgccggcgagctgtcgatcaatacgttgaagctgcgtctgtcagcgctggcgcaatggcataacagtcagggctttgccgatccgaccaaagcgccggtggtgcgcaaagtcttcaaaggcatccgggcattgcatccggcgcaggagaaacaggccgagccgttgcaactgcaggatctgcagcgcgtcatcgattggctggagcatgaggcgcaaactgcgagagagcagcaggatcggccgttactgctcaaggcttatcgtgatcgcgcactgattctgctgggattctggcgcggcttccgcagcgatgaactatgtcgcttgcaaatcgagcacgtgcaggcacacgccggcaaaggcatcaccttgtacctgccacgcagcaagggcgatcgggaaaatctcggccagacctatcaagccccggcgctgctcaagctctgcccggtgcaggcttacatcgactggatcaccgaagccgcgctggtgcgtggcccggtttttcgcagcatcgaccgctggggcaatctcaacgaagaaggtctgcatgccaacagcataattcctctgctgcgtcaggctttgcagcgcgccggcattgctgccgaaaactacaccagccattccctgcgtcgaggcttcgcaacttgggcccatcaaagcggctgggatctgaaatccctgatgagttacgtcggttggaaggatatgaagtccgcgatgcgctatgttgaagccagcccattccaggggatggctcggattacggataacccggcttcgtcgtagatatcgttttcttctattaatacagtcagctaatagcgaaaacaaatcagcagcatcaggtttgccaatgagccatccgtcgagtgagtgggtaggattcacccatcgaattcacaaccactgacggagagtcatcaatgcctatcatcaacagccaagtaaaaccgttcaaagctaccgcgttcaaaaacggcgacttcgttcaagtctcggacgctgacctgaaaggcaagtggtcggtcgtgttcttctacccagccgacttcaccttcgtttgcccaaccgagctggaagacctggctgacaactacgctgctttccagaaactgggcgtagagatctacagcgtttccaccgacacccactttgcccacgctgcctggcacaacacttcgccagccatcggaaaaatcgaatacaccatgatcggcgatccgacccacgccatctcccgcaacttcgacgtgctgatcgaagaagttggcctggctgaccgtggcactttcgtgatcaaccctgaaggccagatcaaaatcgttgaactgaacgatggcggcgttggccgtgacgcttccgagctgctgcgcaagatcaaggctgctcagtacgttgctgctcacccaggcgaagtttgccctgccaagtggaaagaaggcgaggccactctggcaccgtccctggacctggtcggcaagatctaagtctgtgacacgcaacgcagggcggtacgccgcaccttcttaagtacgctgcaccgcccaaaaaaatgcccgggcgagattcgctcgggctttttttcgcctcaaataaaggaaatcgcccgtatgttggacgccaatcttaaagcccagttgaaatcgtacctggaacgggtcacccagccgatcgagatcgttgcttccctcgacgacggtgcgaaatcccgtgaaatgctcgaactgctgaaagacgttgccagtctttcgagccagattaccttgatcgacagcggtgacgacgcgcgcaaaccatcgttctcgatcaaccgcccgggcgcggacatcagtctgcgtttcgccggcatcccgatgggccacgagttcacctcgctggtactggccttgctgcaagtcggcggccacccttcgaaagccagtgttgaagtgatcgagcagatccgttcgctcaaaggccagttcagcttcgagacttacttctcgctgtcctgccagaactgcccggacgtggtccaggcgctgaacctgatggccgtgctcaacccgaatatccgccacgtcgccatcgatggcgcgctgttccaggacgaagtcaacgatcgcaagatcatggctgtgccgagcatctacctcaatggtgaaaacttcggtcagggccgcatgggtctggaagaaattctcgccaaactcgacaccggcgccatcgagcgtcaggccgagaaaatcagcgcgaaagaagcctttgacgtattggtcgtcggcggtggccccgccggtgcttcggcagcgatctatgccgcccgtaaaggcatccgcaccggtgtagcagctgagcgtttcggcggtcaggtgctggacaccatggccatcgagaacttcatttccgtgcaggaaaccgaagggccgaaactggccacggcgctggaagaacacgtcaaacagtacgacgtcgacatcatgaacctgcagcgcgccgacaagctgatccctggcaagaacggcgaattgcatgaagtgcgcttcgccagcggcgcaaccctcaaagccaagagcgtgatcctggcgaccggtgcgcgctggcgtgaaatgaacgtgccgggcgagcaggattaccgcaacaaaggcgtggcgtactgcccgcactgcgatggcccgctgttcaaaggcaagcgcgtggcggtgatcggcggcggtaactccggcgttgaagcggccatcgacctggccggcattgtgtcccacgtaaccctgctggagttcgacgtgcagttgcgtgctgacgccgtgctgcaacgtaagctgcacagcctgccgaacgtcaccgtgatcaccagtgcgcaaaccactgaagtcaccggtaatggcgagaaggtcaacggcctgcgctacaaggatcgcaatactgatgagctgcgcacggtcgagctggaagggattttcgtgcagatcggtttgctgccgaacactgactggctgaagggcactatcgagctgtcgccgcgtggcgagatcattgtcgataaccgtggcgagacttcgatcccggggatcttcgctgccggtgacgtgacgactgtgccatacaagcagatcgtgattgcggtgggcgagggcgccaaggcttcgttgagtgcttttgatcacttgatccgcacgtcggccccggcttaaacgtccggccagaaatgaaaaacccgtgagtgatcacgggttttttattgcgtgtgaaacgttgcccctcaccccagccctctcccgagggagagggagccaaccgagggggctggcgttttccatcgacctgaatgaccgagtcgattatggattcggtaaagatctttcacgtcggcggaattcttgaatatcccccaatcagctctctctccctatgggcggtccgacgtttcgggagggtgagggtgaggggcttttttcagcctttacagcggcgcaggctgaatgatctcgacccagtaaccatccggatccttgatgaacgccaggcttttcatgcggccatcgctcaggcgcttctggaaatcacagcccagctcttcaaaacgtgcgcacgcagcaacgatatccggtaccgaaatgcagatgtggccaaaaccacgtggatcggtatttccgttgtgataagcgaagtccgcgtcgttctcggtgccgtggttgtgcgtcagttcgagaatgcccgggatcgatttcatccactgggtacgtgcagcggcgtcggccgggatctgcgccttgtcgaccagtgcgaggaagtacaggctgaactcggcttcggcgaagtcacgtttttcgaccagcgagaaacccagcacgcgagtatagaagtccagggatttggtgatgtccttcacgcgcaacatggtgtggttgaagacaaagtgttgggttgcgctgtctggtgtggcggtgacgccgggaaaggtgttcagttcgtgcaggctcatgggccctccaataactatgggcgagtgatgggcgcaatgatacgcatgcccgccggcatcgccaaatgaaaggcgggcttgccctgaaagtgagcgaggctcagactttacggctcaattagcgagtgcgcctggcaatgatccgactgttcaaatccctgtttgttttttccgctttgtcccttggcgcaacttgcgtgctggcggatgcaccggacgtcacctggcctgcaggctgggaggttgaagcgctgccgcaagcgtcgccgcaggtttcccggcaacgggcggtaaagaacgatgccgagggcaatcaggtgatggtgatggagttgaccatgacgcaggtcgagactggccatcaggtcaacttggagggcgtgctgctggaaatgcgcaagtccatccagaagggtttctttcacgacggctaccagagtgtctgtaacaaaatccatccggcaacgctcggttctttgtccgcgctggagacgacttgcacgatcactgaaaacggtcgacacgtgttgtcgcaaaccctggtcgccgcagtcgaggcggacaaggcctatgttctttcctacgcaggacaggccgaggtgtataaggcaagtgccgatgaaatagtggcggtaaaaaacagcctgaaactttagtcatctgttctatgcgtgactcgactagatacccgaacggattaagcacaaagttaaacgtagatcgggaatggcaacatcacgcggcgaaacgtttaaggtttttctcagcagcgttacagactattcctaacttgctcgatgaaattaatttcatttgttagatattgtcaataaaaaagccctgcatagagcagggctttttttgttggcgtgagattaaccgcgcaaccaggaatcaacggtggcggcaccgtattgttctttccaggctttcaggccgcggtggttaccacccttggtctcgatcagttcaccggtgtgcgggttgtgataaaccttgaccacgcgtgcgcggcgggttttcggtgctgccgaggtttgcagagcggattttgccggattcggatcgagaatggagatgatgtctttcaggcctttgccgtaggttttcatcagcccctggagcttttcttcgaattcgatttctttcttcaacccggcatcgttcttcagcgattccagctgcttgagctgttcctgaagggccttttcagctgcacgaaattcagcgagtctggacaatatctttactccaatagtgtgtttggctgataccaaccgcaaacaaagctataagccaagagccttgaaacgactccgtgataaatggctcacctgcgaatttttgctcaggttgaaaaaattgtagtagttaatgcgtccagagtaaatcctgatgttgtcttcatgtaacaacagcggtcttttgtatcaatttggtgcgcctgatcggcgtgtcaagcttaacgccagtaagttaatgttgacttaatgcgctgatgaagtcggcggcaggcattggttttccgaagagatagccttgcagaaagttgacctggtgcgcggtcaggtagtccgcctgcgcttgagtttcgacaccttcggcaacaatccccagatcaagcttggccgagagttcgataatcgtgtcgagaatatgccgtgacagcgcgtcgatcccgatcatggcaacgaaactctggtcgatcttgagaaaatcgacattgaacttgcgcaaatagccaaggctggaatggccggtaccgaaatcgtcgatggcgatcttcacccccaaggtatgcaactgttcgaacagttggtgagtgatgtcggtcggttcaatcagttcgcgctcggtcaattccaggatcaggctgatgctgccaggtgcgaacgctgcgagaaactggcggcattcgtcaaccagttccagatcccgacaatgacttgcggtgatgttgatgccgaggtggaagggcgtggcgaagcttgatgacagcggccccagtacggcggcggtctgctgcatcaacgaacgggtcatcggcacgatcaatccggagtgttcggcaaacggaatgaacaggtccgggcgtaccaggccttctttgggatgatcccatcgcatcagcacctctgcgccagaccattttttgctgtcgccgtgcacgacgggctggaagtaggggatgaactcgccagcttccagcgcgcggagcatttcatggctgggtgacgtagagcgtttttgcaagacatgaccaatcgcaccggagactattccaaagaacatcaacaagctgaacagcggcggatattcgtccgccatgtaacgccacgtttcgccttgcgggtaaccggcggcgacattgaaggcatagcgcgacgactgcagcatgctttgtgcaatcggcagcgcgggaaggctgccttggtgcactttgccgtcggcggacagccagttgtcgccgacctgcagcagcaacagggtttgccggccaatcaagcgcagaatgttgttcaagtgataaccgtcaagcgtggtcaatgcgccgccacgaccctcacccaagcggtaaaccagcagcgcggtatcgggcgtcaccgggttgccgttcataagccacaacttgccctcgtggtaatcgccggagttgaccgcttccttgtagtcaccgaacagcgaactgcaatagagattgttgtcccagaccagattggtcgagcgtacaaacggtcggcgagtgacctgctcgcgcaacgccagtttcacctcttcgcaggtttttccggccagtggcagtaggtctttggccgcctgcgcagtgttgtcgagcatcaactcgaactggcgcagcgcctcggtggcggtctgccgggtgctctgctgcaaagtgcgctcggcctgcatgtagagaatcacaccgccgagcgccactggaagcaggccgctgagcagggtcacgacgaggcgggtgctgcgttttcggcgaggtctgacggttaatggcatgggcgcatcctgtcgcgatgaagggggactcttgaatgcaggctggagaatggcgcgctgctgaaaaacagttgagccatcggggaggatagatggcagatgccgcttgcgccgctcagggatgatttatccgcgtggccaactcgataaaggccagtgtggcgggtgaggcctggcgctgatcaaggacggcgaggccgacctggcgtttgacttgcggcgacagcgcaactttcacataccgtggattctgcgcctgcggtagcgagctttcagcgacgacggtgatggcatcgccacgactgaccgtgtcgagagtgctgagcagttgcgagcagcgaaaacggatattcggttgcaagcgagcagcgctgaacagtcgcgacaccagctccgaagatcccgcttctgtaagcacgaatgggtcgtcgcacagctccctgaggttcaccgtcgagcgcgtcgccaagcgatggtcaagcggcagcagggcaaccatctggtcttcgatcacggcaaaggtgtcgaagcgctcttcaggcagtaccacgaaaccgatgtcgatccgccgctcttccagccactggatcacctgtcgatccggtccttcatccatatgcacttcgatgcctggataggcgacgcgatagcgctgcaaaatcgccggcaacagcttgaccgacgaagtcgggccgaatgagccgatgcgtaaagtgccgcgcttcatgccacgggcatcggcagcctcctgacgcaacgtgttggccagacccagcatggcccgggcacgcagcaacaactgttcgccgatatcgctgagcgctacttgtgactgatgccgacgcagcagttcgacgcccagttcctgctccagtgatttcagcgcgtgcgacaccgctgactgggaaatgcccaaacgatgggcggccaaggtaaatccgcgcagctcggcaaccagcgagaagatttccagctgtgtgagagtcatgagtatttactcattttacgatgaacaggaatgagatggatcatacgccatccttcagttacccggattcaagccttatgcataatcttcagcaaacccaaccgacaaccaccgacatgccggtctatctgacgttggcggcagtcaccatggtatggggcgggacttttgtcgccgggcgttttctcgctggcagcctcagcccgatgttcgccgccagcctgcgcttcctgcttgccagcgcagcgttgctcggatttctgtggctggcgcgaattccgttggcacggcctgcgccacggcaatggctgcaactggcattgctggggttcttcgggattttcttctacaacgtgtgtttcttttatggcttgcagtacatcaacgcctcgcgtgcttcattgatcgttgcgttgaatcccgcggtgatcggcctcgcgtcgtggttgttgttcaaagaacgtctggcacgcgtgaaagtcattggcatcgtggcgtgcattggcggtgctggcgcggtaatcgtcagccgcaatccacaactgctggcagcaacgcccgacgcctggatcggtgacgtactgatcctcggttgcgtgctgggctggggggtgtattcgttgttttcccgcagtctcaatcaggcgctcgggccggtgcagaccgtgacgtactcgatcctgctcggcacgctgatgctgtggacgctggcggcggtgcgcggcgaactgagctggacggcgttgctcgacctgggcgtgacgcagtggttgagtcttgtctatttaggcgtgtgcggttcggcgctggcgtacatcggttactacgacggcattcgcaaaatcggcgcgacgcggtcaggggtgtttatcgccttgagccctttgactgccgtgttgctgggcgcgctgctgctcggtgagcatctgacgctagccatgtatctgggcggtgcgttgatcctggcgggcatttatctgtgcaacaaaccccttgcgccgtcggcaaaaaagcggattttatagagagagcagacaagcctatttacgctgtgtagaatcgggttacgcatacaataataatcgtcttctggcagcagaagcctcgcccgcaagagccttgggtcgacaatgaagatattcgggtttcaactgatctacggtgacttcctcgcccgcagtgtgcgtggcatctcctgcgcgccacccaccaacctcgcatgactgacaaataaccctggttaatttgataagaatgatgaggcgtcaccatgacagatttatacgaaaacccaatgggcctgatgggctttgaattcatcgagctcgcatcgccggtgccgggcaccctggagccgatcttcgagatcatgggcttcaccaaagtcgccacccaccgctcgaagaacgtgcacctgtatcgccagggcgcgatcaacctgatcctcaacaacgaaccgaacagcgtcgcttcgtacttcgccgccgagcatggcccgtccgtttgcggcatggcgttccgcgtcaaggattcgcaaaaggcctataaccgcgcactggaactcggcgctcagccaatccacatcgaaaccggcccgatggagctgaacctgccagcgatcaaaggcattggtggcgcgccgctgtacctgatcgaccgtttcggcgaaggcagttcgatctatgacatcgacttcgtgttcatcgaaggcgttgatcgcaatccggttggcgctggtctgaaaatcatcgatcacctgacgcacaacgtgtatcgcggtcgcatggcctactgggcgaacttctacgagaagctgttcaacttccgcgaaatccgctacttcgacatcaaaggcgagtacaccggcctgacctcgaaagcgatgaccgcgccggatggcatgatccgcatcccgctgaacgaagaatcgtccaagggcgcaggtcagatcgaagagttcctgatgcagttcaacggcgagggcattcagcacgttgcattcctcaccgacgacctgatcaagacctgggatcagctgaagaaaatcggcatgcgcttcatgaccgcaccgccggacacctactacgaaatgctcgaaggccgcctgccgaaccacggcgagccggtcgatcaactgcaatcgcgcggcatcctgcttgatggcgcgtcggagcagggtgacaaacgcttgctgctgcagatcttctcggaaaccctgatgggtccggtgttcttcgagttcattcagcgcaagggtgacgatggtttcggcgagggcaacttcaaggccttgttcgaatcgatcgagcgtgatcaggtgcgtcgcggtgtactcgctaccgagtaatccgctacaccgatagacactgtaggagtgagcctgctcgcgatagcgttttcagatccggcaatgctggtgactgaatgaccgcaatcgcgagcaggctcactcctacatttttttttgtttggcttaaggacggcgttggcgcatcagatgtttgaagccttcgaacaccagcaccacaaccgccatccagatcggaatatacgtcagccattcgccagacttgatgctctcgccgagcagcagcgccacgccgagcaacagcaccggctcaacataactcaacaatccaaacagactgaacggcagcaggcggctggcaatgatgtacaccaccagtgccgaggcactgatcaaacccagtagcgggatcagccacatcaaccccgggtattgatcgaacacgcccaaaccttgctcacccccacgcacgaaccaatacgcgactggcagcatcagcgtcatatcaacccaaagcccgccgaggtgatcggttttcaggtatttgcgcaggacgaagtacagcggatagccgaccacgaccaccagtgtcgcccaggaaaatccgccaacctgatacagctcattcaacacacccagcgaagcgaagaacaccgcgattttttgcaggtacgacaggctttcgccgtaggcgatccgtccggtcagcaccatggccagcggcagcaggaagtagccgagcgacacatcgaggctatagccattgagcggtgcccacatgaacagccacaactgcacaccgagcagagcggaagagacgatcagcccggcgatcagttttggcttcgcggccatcagccgaaccagctccagcacccgtcgccactcgccagagaccaacatgaacacggtcatgcacggcaccgtcagcagcatccgccagccgaaaatttccacgccgctcaatggggtgagcagcgaggtgtagtaatacatgacggcaaacagcaccgaggccgcaaccgataaagcgatacctttagacaaactgtcctcgcgggtgggtgatcaaacggggcgcgaaggatacgtggtttttgtgctgaatattggccggatgctcattattttcaacacgtacatccccacaattgtaggagctgccgcaggctgcgatcttttgattttaaaaaaaacagatcaaaagatcgcagcctgcggcagctcctacatggatggcgtcaggcagagtgggttttgcggccggacacaaaatgactgacatcgttgaagcccggtgtcgatgcatgccccggtgtcaccagcgaatcgatgaacgcttcatcttcagcggtgatcttcaccgcctgcgccttggtgtaggcatcccactgcgcttcggtacgcggcccgacaatcgccgacgtcaccgcgctgttgttcaacacccaggcaatcgcaaattcaaccatgccaacgccacgttgttcggtgtactgatgaatttgctgggcaatgcgcaacgactccacgcgccattcggtttccagaatgcgtttgtcctgacgcccggcgcggctgttggcatccggtgtcacgtccggcgcgtacttgccactgagcacgccacgggccaacgggctgtaaggcaccacaccgaggccgtaggtctgcgcggcggtaatctgctcggtctcggcctgacggttgacgatgttgtacaacggttggctgatcaccggccgatcgacgcccagtttgtcggcgatacgaatcacctcggcaatccgccagccgcgatagttcgacaggccccaatagcgaatcttgccttggcgaatcagatcgccaatcgccgaaacggtcacttccaatggcgtgttgtggtcttcgcggtgcaggtaatagatgtcgaggtagtcggtgcccaaccgggtcaggctggcgtccagaccattgaagacatgcttgcggctgaggccgctgcggtttggcacaccgtccaccgggccgaacccgaccttggtcgccagcacccactcatgccgattgccggcaattgcttcaccgacgatctcttccgaacgaccgttggtgtatacgtcggcggtgtcgatgaagttgatgccctgatcccaggccttgtcgatgatgcgcaacgactcttcggtactggtctgctcgccgaacatcatcgtaccgagcgtgagggtagacacctgcaaccccgaatgccccagtgtgcgatagctcatgccgaaatccttttgtcggtgggaaacctcaacaaatagcagatgtgtaacagggcgcaaagtgaattgttgcggcgtttaaacgcaaaaagatcgcagcctgcggcagctcctacaaggaacacattccaaggaaggagctgccgaaggctgcgatcttttgatcctgctcttgtaattaagcccgcaacgtccgcgtcatccgcagcgccaacagactcccgccaacaatcacacccgccagcagatacaacgccgcatcggtcgagccggtgctgtccttgacccaaccgaccaggtacgggctgaggaaaccggccatctgccccatcgagttgatcaatgccagaccaccggctgcagcgccggcactcaacatggcggtcggcactggccagaacattggcaggccggtcagcgcgcccatggtcgcaatggtcaggccgagaatcgcaatcgccgggttgcccgcaaagttcaccgcgattaccaggccgatcgcgcccatcagcatcggcaccaccaagtgccagcgacgttctttgcgcagatccgccgagcgaccgacgaccagcatgaacaccgccgccagcagatacggaatcgcgctcaaccaaccgatcaccaggttatcgctgaagccgaggttcttgatgatcgacggcagccagaagttgatcgcatacacgccactctggatacagaagtagatcaggccgaatgcccagattgccgggttcttgaacacggcaatcaacgagtcggaattggttttcggcttgttcgccaggtcttcggcctgatccgcttcaagcaccgcgcgctcgtgcggggtcagccacttggcattggcgaagctgtcgctcagcaggaagtaggcgagggcgccaaggaccaccgtcggaatgccctgcagcaggaacatccactgccagccggccagaccgccctggcctgcggcgaagtgattgaggatccagccagagaacgggctgccgagcaaaccggataccgggatcgccgacatgaacagcgccatgatccggccacgacggaaggtcgggaaccattgcgagagatacagcacgacgcccgggaagaacccggcttcggccgcaccggtaaacaggcgcagggtgtagaactcggtcggggtggtgacgaacaacaggcaggtcgacagtgtgccccaagtgatcatcatcacggcaatccagcgccgaggaccgaacctggtcaacgccaggttgctcggtacgccgcacagcacgtaaccgatgaagaagatgccggcaccgaggccgtacacggtttcgctgaatttcagtgcgtcgagcatctgcagtttggcgaatccaacgttgacccggtcgaggtagttgaacaagtagcagatgaagatgaaggggattaaacgcagggtgatgcgtttataaacggcatttttatcgtcgtcgatggtctgggtagctgcggcgctgtgcgacatagcggctctctctttattatgattttttgcgatgcaaagggtaacgttgatcgccctgagagtctcggccaaccttggcaggattgtctttgtgcctgagcacagggtttgccgccagaccctgtgcgggtgaacaaccgccagtgccagaaaataaggattgccgccgttatgtttgaactcgatcacgacctcgcccaggacatcgtcgaccgggccatggccattttgccctacaacgtcaacgtcatggacagccagggtctgatcctcggcagcggcgaacccgagcgtatcaacacgcgtcacgaaggtgcgcaactggtgctggccaacggtcgcgtggtggaaatcgatgcgcaaaccgctgtgcatttgaaaggcgtgcaaccggggatcaacctgccgctgctgctcgatcaacgtctgatcggtgtactcggcatcactggcgagccggagcaactgcgcacttacgctgagctggtgcgcatgaccgccgaaatgctcgtcggccagcgcaatcagcaggccgagcagcagtggcggcggcagcgctgcgacgatctgttggcattgctgttgagcgaggccggagattcgccgcggttgattgatgaggcgcagcaattggggctcaagccgcaattgacgcgggtgccgtacctgtttgagctgggtctggagcatgggccgggacaaaccgtcgatgcgctgagtgcctggctgacctcgcgctatcccgacagttggtgcgtaagttcggccaagtcgtcactgctttggtgtcggccagcgagtcacaacgtcgagcatgatcggctgctggaaaaactcgacggtctgggctggaacattttgcgcattgccgtcggcggccaggcggatggcttgctcgggctgcgacgttgctatcgacgggtcggcgatttgctcgcctatggccgtgaagtgttaccgcattcacgcttgctgacgctcaatcgctatcgcttgccggtgatgttgtggcggcatcgcaatgacgatgcgctggatgaattgctcaagccgctgcgcaaggtgatcgccaaggacggcaacggccaattgctggcgacgctgcgcagttggtgcgaacacgacgggcagagtcaggcgtgtgcggatgcgttgggcattcaccgcaacagtttgcgctatcggatggagcgaattgccgagttgagtggggttgatccgttgcggctggacgggatgttggcgctgtatcttggggtgcagttgctgccgcagatcgacccgaattgatcggtgtccccaaggacgccatcgcgagcaggctcactcctgcaattggaatgcattcccctgtaggagtgcgcctgctcgcgatggcggcggtacattcgccgcagagtcttttgtggaaatgaacaataaacgcccacgccgcttgtgcagcggaccggcgtcaatgcgcatgccgactggcagcatgaggggcattggaactggagaattcgcatgaaaatcgtcatcgcccccgattcgttcaaggacagcctgagtgcccaaggcgttgccgaggccattgctttgggtctggcgcaagtctggccgcaagccacgctggtcaaatgcccaatggctgacggcggtgaaggcacggtcgagtcgattctcgcggcctgcgaaggcgagttgcgccgcacccgtgtgcgtggcccgctcggcgcgccggtcgacgccgcgtggggctggttgccgcacaaccgcactgcgatcatcgaaatggctgaagccagcggcttgcaacgggtgccaccggggcagcgtgatgcctgtatcaccagcacatttggcaccggcgaactgattcgtgcggcgctggatgccggcgcgcaacgggtgattctggcgattggcggcagtgcgaccaacgatggcggcgccggtacgatgcaggcgctgggggtgaaattgctcgatgcgcaaaatcagacgctggtaccgggcggtttggccttggcgcaactggcgcgagtggacatcagcgaacttgatccgcgtctggcgcatgtgcgatttgatatcgccgccgacgtgaacaatccgttgtgcggcccccacggcgcgtcagcgattttcggcccgcaaaaaggcgcttcgccggcgcaggtgcagcaactcgatcaggcgttggggcacttcgccgacctgtgtgccgaggcgctggacaaagatgtgcgcgatgagccgggctgcggtgcagcgggtggtttggggttcgccgccaaggcatttcttggcgcgcaatttcaagccggggtagaagtggtcgccgaactggtcggcctcgctgaagccgttaaagacgcggatctggtgatcaccggcgaaggccgcttcgatgcccagaccttgcgcggcaaaaccccgtttggtgtggcgcgcatcgccaagcagcacaacgtgccggtgatcgtgatcgcgggcaccttgggcgagggttatcaggaactctacaaccacggcatcgatgccgcttttgcgctgaccagcggcccgatgacgctggagcaggcctgcgcagaagcaccacgcttgctgcgcgagcgcgctaccgacattgcccgagtctggcgactcgccagcaaaaactgacccgcctctgtaggagctgccgaaggctgcgatcttttgatcttttttttagagcaagtccaaagatcgcagccttcggcagttcctgcatcaatattggaatcgcagtgtttcattcatgtaacaccctgaaaaatagttgatcttgccccgcaatcttcctaaagcctggccgatacagctaacaggcgcgcacacacccccaaaacagtgacgccggactgaagcccaccccgcgggccagtgataacggcatggacgctcgtagtttttatcttccgagagtccaatcatgtccttgcgtaacctgaatatcgcgccccgtgccttcctcggttttgccttcatcgccttgctggtggtcgtgctcggcgtgtttgccgtcaaccgcatgtcgatcatccgccaggcttcgatcgacatggagtcgacgcaactgcccagcgtcacgcatctcgctgtggtgacggaaaacgtcctgcgtctgcgcatcctgtcgttccgcgtgctggtcaatcgcgaaccggccggtttgcaggaagcccagacccgcatcgccacgttggtcgacaaggttcgcagtgcccaggccagttacgccgcactgccggcgggcgcggaagaacgtgcgttgtatcagacgttcgccagcacgctggacaactacctgcaagcgcagaaccaaatgatggagctgtcacgtcaggacaaaatcgatgagatgcgcagcctgatcaacacgcggatcaaggacggcaccgaccaaatgggccagcaactcaacaagctgattgcgatcaacgccgctggcgctaaagccgcttcgaagcaggccggtgaaaaatacgacagtgcgattttcggcattgtcctcgtcgccattgttgccgcgctggccacggtgctgctggcctggttgttgacccgcagcatcgtcacccccttgaaccgcgccgtcgccgctgcgcgcaccattgccgagggcaacctgaccaaggtcatcgaaatcgatggcaacgacgagccggcgcgcctgctggaagccttggccgcgatgcaggccaacctgcgcaaaaccatcgaacagatcgccggctccgccacgcaactgggcgccgctgccgaagagctcagcgccgtgaccgaagaagcctcccgtggcctgcagcagcaaaacaacgagatcgaacaagccgccaccgccgtcaacgagatgaccgctgccgtcgaagaagttgcacgcaatgcggtgtcgacttcagaagcgtcgaaccaatcgacccacgccgcgcgcgagggtcgcgatcaagtggtgaaaaccgtcgacgcaatccagaccatgacccatgacgtgcagaacaccgcgcaaatgatcgaaggcctcgctgcgcaaggtcgtgacatcggcaaagtgctcgacgtgatccgcgccatcgccgagcagaccaacctgctcgcactcaacgccgcgatcgaagccgcgcgtgccggtgaggccggtcgtggttttgccgtggttgcggacgaagtacgcgcgctggcccatcgcaccgcgcagtcgacccaggaaatcgaaaaaatggtcgccggcattcaaaacggcaccggcgaagcggtttcgtcgatgcaacagagcaaccaacgcacccagtccaccctggaaatggcccgtgcggccggcgtcgcgctggagcagattacccagtcgattcatcagatcaacgagcgcaatctggtcatcgccagtgcttcggaagagcaggcgcaagtgtcgcgtgaggtcgatcgcaacctggtcaacattcgtgacctggccacgcaatcggctgccggggccaaccagaccagcgccgccactcatgaactgtcgcgtctggcggtagatttgaatgccatggtggcgcgttttgtgatttgagatagggtgaagactggagaccgcgccatcaggagacgtgcatgcgctattcagccttgacccaacgaatcgccggggaaggagccgctgcctggcagattcacgatcgagcgctggagttgcgcgccgagggcgttgatgttctgttgttgagtgtgggcgatccggatttcgatacaccgctgccgatcattcacggcgccatcgacagcctgttggcgggcgacacgcattactccgaagtccgtggtcggctggcattgcgcaagttgattgccgaacgccatcggcggcacagtggtcaggcggtcgatgccgaccatgtgatcgtcatgcccggtgcgcaatgcgcggtgtattcggtggcgcaatgtctgctcgatccgggcgatgaggtgatcgtcgccgagccgatgtacgtcacttacgaaggtgtgtttggggcgtgtggcgcgacggtcgtgccagtgccggtacggccggaaaatggttttcgcgtcgatccggcggatgtcgcggcacgtatcacgccgaggacccgcgccatgctgctcaacagtccgaacaatccctctggcgccagcctgtcgctgttgatctggcaggaactggcggcgctgtgcgtgcggcatgatttgtggctgatcagcgacgaggtctacagcgaactgctttatgaaggtcagcacgtcagcccggcgagtttgccgggtatggctgaacgcacggcgaccatcaacagcctgtcaaaatcccacgccatgaccggatggcgcatcggctggatgatcgggccgaaatcgttggccgagcatttggtcaatctgtcgctgagcatgctctttgggctgccggattttgtgcagaaagcggcggaagttgcgctggcctcgtatctgccggaagtgacgcagatgcgcgaggagtatcggctgcgtcgtgacctggtgtgcgagcgtttgcaggggtgtccggggttgtacccgatccgtcccgatggcggcatgttcgtgatggttgatgtgcgccagacgggccttggcgctcaggcgtttgccgagcagttgctggaaggttatggcgtgtcggtgctggccggcgaagcgtttgggccgagtgcggcggggcatattcgcatcgggctggtgttggatcgggtgaaactggcggatgcctgtgcgcggattgctctctgtgcggcgcagcttttacaggcgcgtagtgcctgatggttttgcagggccttcactggcctcatcgcgagcaggctcactcctacaatgatttgaggtgtacacaaattcagtgttcaccctgacccttgtaggagtgagcctgctcgcgatagcgatttaacaggcaataaaaatctcagccctgccaggccaatggattcaccagattcgccggtttttccccactcaatgcggccaacagattctccaccgcacaccgcgccatcgcctcgcgcgtttcatgcgtcgccgaacccatgtgcggcgtcgccacgacgttgttcaactgcaacaacggcgagtcatgctgcaacggctcacgctcaaacacatccagcccggccgcgcgtatgcggttattgcgcaaggcttcgatcatcgccgcctcatccaccactttgccccgggaaatattgataaagatgctttgcgggcgcatcaacgcaaactgctctgccccgatcaaaccttcagtctgcgcggtcagcggcaaggtcagacaaatgaaatcggcctgctgaagcagatcctcaagactacgatattgcgcatcaaaccgcgcctcgaccgccggtttgcgcgactgactgtgatagagcaccggcatgccaaaaccgaaatggccacgctgcgccaacgcctcgccgatgcgccccatgccgatgatccccagcgtcttgccatgcacatcggtgccgaaatgcgccgggccgatgttgcggctccattgaccgctacgcaccatgttcgccaattcgaccacacgccgggcggcggcgaggatcagggcgaaaccggtgtcggcggtggtctcggtgagtacatccggcgtgttggtgagaaggatcttgcgctgcgtcaagtaatcgatgtcgtagttgtcgacgccgaccgagacgctggcgatggcctcaagctgcggcgccagatcgagtaacgcggcatccagtttcaggctggcaccgagcagaccgtgagcgcggggcagggcgtcacgcagttgcatgaggccgtcggcgtcgaggctttcgatcagcgcgacctcgcactgttcctgtagacgcgccatcagcgctggcgacagtttcttgtacaacacgacttgttttttcatgacaaaaatctcttcaggaatgcgccggcgcggcacgcgtggcgacggctttggcaacgacgcgatcactggcgccgggcttgaggaacatggtcagcaccaccgacagcagcaacgcgccgctcatcaacaggtacgaagcgccgggcgaaccggtcgaactgttcaggtaaccgaccagatacgagccgccaaatgaaccgagcgcgcccatgctgttgatcagcgccatcgcgccaccggccacgttggcagggagaatctccgggacgatcgcaaagaacggtccataaggcgcgtacatgcaggcgccggcaatcaccaatagcgtgtatgaccaccagaagtgttcagcgcccaaggcgtaggagccgtaaaaggcaatggatgcaatcaacagtggtggccagacaaagcgtttgcgcttttgtagtttgtccgagccccacgacacggcgagcatgccgatcaccgccgccagatacggcagcgccgacagccagccagcctcgatcatgtccatttgcgcgccggccttgaggatcgacggcagccacaagacaaagccatagacgccgatgctccagcagaaaaactgcagcgccagaatgatcaccttcggcgaacggaacgcctcggcgtagttcttcacggctttgataccgacctgctcggcagccaaggcactttccaggtcgtgcttttcctcatcgctcagccacttcgcctgggacggacgatcatcggccagacgccaccagataaacgcccacagcaccgccggcaaaccttcgatgatgaacatccagcgccagctgaaatgctgcaccaggtaccccgagaccactgacatccacagcatcgttaccgggttgccgaggatcagaaaggtgttggcacgcgagcgttcggcacgggtaaaccagtggcacagatacaccagcatcgctggcatcactgctgcttcaaccacgccgagcatgaagcggatgacgatcagccaataagcgttggagaccacgccggtcaatgtggcgaggccgccccagaggatcaggctgacgaaaatcagctttttcacactgtgtttttgtgcgtagatcgcaccgggtacctggaagaaaaagtaaccgagaaagaacagcgcgccgagcagcgacgacagtcccggagtgatcatcaagtcggcggccataccggacgcggcagcgaagccatagttggcgcgatcaagatacgccaggctgtaggtgatgaacacaatcggcatgatgtaccaccaacggcgggtggcgagggttgcggttttcatgggtgttgctcctgagcttgttgtttttgtcgcagcaggttcaataaatcggttgtctctcagggcctcatcgcgagcaggctcattcctacaggagaacgcattcaaatgtaggagtgagcctgctcgcgattggcgtcttcgaattcggtaaatagttcagcccgggttggaaggccctccatatccccgcgactctgcaccgcacgactgccaatccagttcgcccgctgcaccgcctcggcaaaactctggtgttccagcaaggcgctgatcattcccacggcaaaaccgtcaccggcaccgaccgtgtcgacgacattggccaccggcaccccagcgacaaatcccgacgccagatgcgttcggtaataagcgccttccggcccgagtttgatcgccaccgcttccgcaccttgatccagataaaacgccgcaatgtccgccgggtcttcaagcccggtgagcaagcggccttcgctcaatcccggcaacacccaatgggcgagggcggcgaggcggttgatctcgcggatcatttcgcgctcgctggcccacaggcttgggcgcaggttgggatcgaacgacacgctgcgaccggcgttgcgcatgcgcgtcatcagttcgaaagacatctctcgcgctgaggccgacagcgctggcggaatgccggtggcgtgcaggtgtcgcgcgctcagcaggttggcggtaatcgactgcggtgacagatgactggccgccgaaccgcgccggaaatattcgacctgcggatcgctaccatcgtcgttgcgggatttgaactggaaaccggtcgggtgctgtttatcgacatcgacatgactgcagtccaggccttctttaatcaacgtctcgaccacaaagcgcccaagcgaatcattgccaacccgactcagccacgcgacgttgaaacccaggcgcgaaaggccgatggcgacattgctgtcggccccggcgatgcgcttgtggaagtgctcgaccgttgccagatctccggtctgctcagcgaccagcatcgccatggtttcgccgaacgaaagaatatcgatctcagacatgagcaggctccagacgcgattggccgaggcgggcgagggcggcgacgtgttcgctggtcagttgcaacagatcctcgccctgcaacggatattcggcggcgcgcataacgccttgggccatgtgccgcagcagttgttcccacagatgcaggtcactgacggcaggcggcaccgcgaccagtttgccgtcggcgcgacgggccacggctttgcagtgcacatagccgacatgccgcccgagcaggcgggcggcgctggtggcggactggtcctgccactgccagttgccgatgtcgaaagtcatcttgatcggcaggttgtgctgttcgacagcgttgaagaagcgttgaaacggttcgatacgcccgccatgcaaggtctggtcgttttccaccagcaactgcacggggctgtgctgcaaacgctcggccaaggcttgcagatcgttattgtcggtgaagtagccgagggagactttcagccatttcgaaccgaacgcttcggcctgttgcagggcggttatcaattcgggattcggttgtgcctgaccggccaaccacagttcggtgggcgaggaatagatgctctgcaggccctgcgcctgagtggcctcggccagttgcgcagggtcttcgcgcgtcagcaattcttcgcgccactcgatgcgattggccccggcggcagccaggatatcgatgaatgaagcttgtccacgctgacgcacaagctcggcgccgtagctggacagactgatggaaacgtcgggtttattcattgttattgacctctgaaaccggtttcatttttgttcaaaaaaatatcaggtgttctgtattgtcctttccgacgctatcgcgagcaggctcactcctacaggggaacgcattccaaatgtaggagtgagcctgctcgcgataggtcagctcaaacaacgctaatccccaaggttgacccacgctcaaccagcaccggcgcaaaatccaccacccgcgccacctcatcatccccacgcaaacgcttgagcaaacactcaaacgcccgcgcaccaatctctgccgtcggctgagccagtgcggtaatcccgctgcccaccaacggataccaatccagatcatccagggcgatgaacccgacatcctcgaacaaccggcaacccatctggcgcaacgcagtcgttgcggccagcgctgccacgccattggcgcagaacaacgcttttggtccggcaccgggcgtatttaaaaaggtttgcagttgtgcgcccagctcatcgccggtttccagcaccaccccagtcagcgccgagcgctgagcaatctgtgcctgaaaactgctgacccgctcgatccgcgaactggtgccgtcatagggttcagtcaccagcaccagattgcgataaccgcgctgctccagatgcatcagcgccatctccacagctagcgggttgttcagcccgaccatgtcgctgtcgagaccgtcgaccttgcgatcgaccagcaccagcggcatctcgcgacgcagttcgtgcaactcgtcacggtgatggcccagggtgttcacgatcagtccttcgatgttgtacgaacgcaatagggccaagtgctggcgctcttgctcgtcatcgcggtcggtgttgcataccaccaggctgtagccgtgcgcccggcaggcggtttccaccccgtgcatcacggcaattgaataagggttacggatatcggccaccagcatgccgatcaggcgcgtgcgcccgcgtttcaggccgcgcgccatttggttggggcggtagccgagttcgctgatggcttgctcgatgcgcagggcgatggcatcagagagcagggcgcggtcatcgccgatgaagcgcgagacgctggccttcgagaccccggcgcgctcggcgacgtcgagcatggtcacgcggctgcgttgggcggtggagaagtcgttcatcgtggcggcaactttcttgttgttggagtgtttgaaacgtcattgaaaccggtttcaggaaacaccaatcggcgtgtgtacgtcaaggtgcgttaatcacgagccaacctgcgtcagaggtctttcgccgacgagcggtcgctttacctgtcagatctgacagtaggcaagtctgttcgctaagcgcttaattccctcagcgttgcgaacggaattttacagggccgtcagccaatgaattctttctctatcgaaacaaataacatcggtatttttgcggttccgctaacgatcgatggcgtcggcacgggcggtgcacttccacctgacgcacccgttaaaggcgtgatcatccgtatacccatgtggccgaatccgtcggtcattcctggtaacttcgatctgattgaaatcatggttctggaacccggagcctccgaggcagaagaacagatttttcacagtgaacgccttccagtacctgtgaccgtccctgatttttttatccttccacctcgatatttacagcgtgacggcgatatccggctcagatatcgcgttactgcgcaagacactggtaatcctgatacgtccttgccgcaatggtacatcgtcagccgactaattcccgtcaacttgttggagccagaatttccaagtgcaactatctgggggtatctcaattgcaattcagtacccaaagtgtgggaaacagtacaaatcaaagtgcctgcgcagcctggacggtttgccgaaaaagacgtcgtcactctggattgggaaggttttcaaagtctcaatggcgtgaggccaatcaaaggaacggcgggacggttctccaaaacattgaccctggcagatgctaattcaactgacggattctcgtttgagctgacttcccaacattacgccaaatatattgagccgatggcaagagatgcttctgctcttgccacctacaccttgcatcgaaataacaccgctttgggaaagtcagaaactggcctggtcaagttcgaccgggttgttcctggtaaaagtaatttttgtgggccggtaacaagtgtgttggacgtttctgaaagcaacaaaatgttagccaaagaagttagcagtctgcagtcgcgtagttttctattgggcgataacgttaattatccaataaatggcatgttgatggagcgtacgaatatgaatatgcaggcgaaacttgggacgggtgtgctggcgttgcctcctgttattgtaggcaatttgccggatggtcgattgacttacgagcagttggtcgttaataaaaaaattactgtgcacttgactgatattgatgataagggcccggacggggcagcaaggattgaactttatctttttcccaagggaacagttcctgtcgagttcgacccaacatttgttgttgtgacgaaaaccaaagccgccgagcccggtggagactggacattccctattgtgttcgaggtcgatatcccggccagggtaagggaggtcttcaatgcgaacggtgattacacaccttttgaattgtcgttcttcatttatgatgcattcgataacgtcgatacctccagtccccacaccgagatcctgctggatcagactgcgccttaccaacgccaacccggtggtccgaacggcacaggtatacggcctacgctgttgaccttgggtgcggggtttcctccagttatcgatgatgcctggctgctcaatcctgccaacagtggtggtttgaagttaaccattcccacggcttatcagaagttcgaagcgagcaaagataaggtcaatttttatatctcgacgcaaaccacgttttctctgatgcagggtgaaggcgcggtggtcgaagactttccagtgccaaccggcggtgttatcaatgtgccgctcagctatttgtcggcgatgaatgaagggtcttacttttattcctacaacctgatcgatttgccgggcaatgtaagcaacaactcggctattaccacgctgttcaggcgcgtcaagactcctgcgccggtattggaagttccaagaatccctgtcacgggcgccaatggcagtgttccgattaccttgtccactgctgctgatccaaccaaagtcatcatggaaatcgactttccgttgaattcgcttccgggtgatcgaatcattccgtacttgacctctgatcaggccggggcagcgattgcgttgcctgaacaaccgattccgccggctggtactgccgggcctctgcttttcgaactggattttgacatcatgtcccagctctttggcgatgccaatgggactcaagaggtggagtttgagtactggtacgaactggagcgctcaacaatcacgcctaacccgacttcggcgtctgtgtttgccatcgtcgacttttcctatgccgggcctgagcaaccgaatctgcccgacttgccgaacatcaacatttctcctgtcgtggtgcagggcgctgggactccggcgccagcaccaaacacactgggtccggcacaggctggtattgcggcaacgatgaattggcctttgtggactgatgtaaaccgtccggtcaccgggcgtgaaatcgtcaagttctattaccaggataaacaggtcggcgaacccattccggtacgggtgggcgacacaaccgtgcaaacgacattgccttgggaaaccattcgcctggaggggaacggtacgggggcagacgctcgcaaagcgtacatcaccatcgagtacccgggcagcgccaacgtgatgaagcagaagatacctaccgatgtccaggtgactgctatcgtgatcaatgtacccgcgcctcagcttatcgtgtcagcgttccgagctgcgagtggaactgttgtgccggagcggattatcaccagcatcaactgccctagccttaatcatcctgttacggtgaacggtccaatgccgccgtatcagccgcgtaatttgcggatccggattatccgcgatgccaatatcccgactggggcaacggtcgatctgacgttcgtggggcgcaccacaaatactccggctggcacggatattcccaacaccactatcacggattccgccccgatgccgccaacgggagatctagagttccgtcttaccgattatgaggcgatcaaaacgatccagttgccgagtactgcaccagggactcgtccagccacccgttacgcccgcattgcctacacggtcaacggcattacatccgaaacgatcgtccctgtggcgcttctgaatacgagtctggtgtattgcgacattgaacggcctgaagtaactccttgattcggcgtatgagttcgtcagcgctggtgaaagtcaactggcttttctttcatcagtgctggcgattttttactttcgaatgaagcctcgtacatgaaaatgagacaagtcctacctcgacgaggatgtttcctacatataactggcttggtaaaccgtagtctgacggccgtctcggattgccctcacatatcagtcatggggggaaccgcgttcgtcaggtaatgttaccgagtagggcctaaatatgtcttcaatatcagattccgcgtttcccagaaacactcttcatttttgtttgcttacatgtattccaattttatttgattcgggattgtcccacgccgccaccgttccagcaggcaccacgcaaaatattgatgccactacaccattggatacctggcaacttgaaaccaatgcttcgttgataggccttggcgccgaaactctcgctatcactggtacggtgggcagtactgtcaacttgaccggctctaccgttacctcagcatctgcttcacaaggaatgttcctgaccaacgccagtgccatattgagtcgcactactgtcaccagtgcgggcgggattggtatgtcagcggttcgtggcgttgccagcgtcggaggatcgacggtgaccttgcgtgaccaatcggtagttcaaggcctacaaggcggggtcgcgggcaatcggttcagcaatatcgatatccagaactccactgtgcaaggcactggaggcagcagttttggtattcgattgcttgaaggcacactgtccgctacctcaagcaccctcacgggtggacgcaacggtttgatcgtcggaaccgacactcaggcatcggccatcattccatcaacgatcctgcttgatggtacgcgggtggaaggtcagggcggctccgccattttggtgggcttcaatgcgccgaatttccctaccattgccaatatcacagtacgtaatcattcgacattgatcggcgccaacggcaccttgcttgaggtcggtcctggtgcttccgcaaaccttgtcgtggacgacagcgttctaaaggggaatgtcgaagtggcttccggcagctcggcaaatgtcacgctgcaaaacaatgcaaccttgagcggcaacttgcaaaacgttaccagcgcgacactcaataatcgggcgaatatgtcgggcaacgtcataggcgcatctaccatgttgatcgacaatgcttccatgttgaccggctacttgcagaatgtcgccaacaccacgatcaacaatcaaagcgttatgaccggcaacgtttcaggtgccgcgaacagcgtttcggccttgcggctggacaatgcttccacgctgatagggcaagtcaatgatgttgccaactttgccatcggcaatcaggcgttgtggcaaatgaccgccagccaatctgtgagtaacctggcgctcgccaatggcggcagggtgaagctgggcgacggccaacagtatttccagcttgatgtggcgaatctgtcgggcagcggtacgttcgagatgggcaccgacttcaacaggggcatcagtgatctattgaatgtgacgggcagtgcagccggtaatcaccagttattggtttcaagtacagggctggaccctgtcagtgatgcgtcaataaaagtggtgcagagcgtcgccggtactgccgaatatggtttggtcaacagcaaagtggatgccggtgcattcacttacaaattgatcaaggaaggaaacgactggtatttgcagcctgacaaggaagttgtcagtacacccacacgctcggtcttggccatttttggtacggctcccacggtgatatacggtgagatggcatcgttgaataaccgcatgggcgatcttcgcaataacagcgagttgaccggtggctgggttcgctcttacggaaatcgatattccatcagcaataacgcttatggcgatggttacagccaaaatcagtatggtttgtccgtgggtgtggacactccaatccggctcgcggatgaaacagtattgtttggcgttttcgcagggtacagcaagtccgatctggacttgaaacgcggcagttcaggcgaaatcgacagcacctcgatcggtgtctatggtacgtggttgggtgagagtggctattacctggatactgttgccaaactcaatcattttcgcaacgatgccaaagtgacgatgagtgatggcactcgtaccaaaggtgattacaacaaccttggcgcgagtgcgtcggtggagtttggtaagcacatcgacatcagcgaggattactacgctgaagttttcactcagtggcaggctgcgtctgtgcaaggcaaggaatatacgctggataacgggttgcgcgctgacgccgacactacacgctctatgcttggcaaggtgggcgtcacgctaggcagaggtacgaccttggcggatggcagtatcgtgcagcctcatgtgcgcgccgcggtagtcaacgaatttgtgaaaaacaacgaagtgcgcatcaacgataataaattcaataacgatttgtccggtgggcagtttgaagtgggggccggagtatcatggacattgactggccgttggcagatgtacgcagaggtggataccagcaaaggtgaaaatgtcagcaaagactttggtatgggcattggtgtccattatcaattttgagtcataaaaaaagggaggcttagccttcctttttttttaatgcttttattcatccagccttcaaaacctgaaaattgcctttcagggtaaacgtctcgccctctgtacctggatactcaagagctgcctggaaactgcctttgacgttgtctccaagcgctggctccagtttgatatttccagagacgctttcatagacagtcccatcagcatctttaaaactaaagtccacatcagtgcgcgatctcaactcataatcgccaacggcgaaattggccggtaatgaaatgtacactgtccgagcagccaggctttttgcctttgtctttgcggcgggtcgatgtacggctgtaataagaacggcgtcggttttttgtggcccggatttcacgttgtctatcagtcgagaagtggcgataaactctggaaattctgttttcgtagcaaatgctgctgcattgacatagttaccgtctgcgaagctggtgcgcttgattaccgctttcatggaatcggtctccgttacgaaagaagaggtacccaaaggccttagccctaatcctggatgagccatctaatactgtccgtataggggttgtatactgtcactgttgacagtttacgaagtctccaatctgtgaaactaatggttcttggataacatcgccggttgccaagtaattgtcgtcttccaggccaccttcaactaaacaacccagccgcaatattgatcgagaagcccaatatcgccgtgttgaatacgaacccgatcaacgattgcgccagcacaatcttgcggatatcccgcgtcgccacgcccacatccgctgtttgcaccgccacgccgatggtgaacgagaagtacaagaagtcccaatagttgggcgtggtcagtccttcggcgaaacgcagcgccggttccttgccatcccaggtgtaaaacaggcgggcgtagtgcacgcagaaaatcactccgatcagtagccacgaaccgatcactgtgagtgcggtaaacccataatgcatgagcttgcgcgcggtttccaggtctttgctgcccgccagttcgaaggtgatggtcgccagactcgccagcgcggcgatgcacaccacgaacagcaccagcccggcattttcgtcttcgacttcagcgatgcgtttgacgtccggggccttggcgcgcacggtcagccagaacatcaggatcaggtaagtccagacaccggcgttccagccaatgaggattttactgacgatggagtcggcgggtgccaacaggccggtggcaaggccgaacagggcggcggcagacaggcgagggtgggtgcgagcgagaaagcgcatggggactcacttggtgaactgtcccagcaccatagctcacacaaccttgcttttgtaggagctgccgcaggctgcgatcttttgatcttcaaaacaacatcaaaagatcgcagcctgcggcagctcctacttttgcatcagtgcctggtgaatcgttgtacgagcttcatgacgacgacgaagaagaccgggacgaagatcaccgccagcgtcgcggtgatcatgccgccgatcaccccggtcccgatggcttgttggcttgcggaactggcgccagtggcgatggccagtggcaccacaccgagaatgaacgccagcgacgtcatcacgatcggacgcagacgcagacgtgctgcctgcaacgtcgcatcgatcaggtcatgcccttcgtcatacaagctcttggcaaactcgatgatcaggatcgcgttctttgccgagaggccgatgatggtgatcagcccgaccttgaagaacacatcattgggcatgccgcgcaacgtcacggccagcaccgcgccgagcacgcccagtggcaccaccagcaacaccgaggttggaatcgaccaactctcgtacagcgccgccagacacaggaacaccaccagcaaggacagaccgaggaggatcggcgcctgattgccggacaggcgttcctgcaacgacaacccggtccattcctgaccaaggcctttcgggccctgcgctaccagacgttcgatttcggccatggcctcaccggtactgtgccccgctgacggttcgccggaaatcgcaatcgccggataaccgttgtaacgggtcaactgcgccgggccctgaatccagttggcctgcacgaacgctgacagcggcaccatgtgcccggtgttgttgcgtacgtgcattttcagcaggtcggcgacctggctgcgttgatcgccttcggcttgcacgacgacacgctgcatgcgcccctggttggggaagtcgttgatgtagctggaaccgacggcggtggacagcacattaccaatgtcggcaaacgatacgcccaaggcatttgcctgcttgcggtcgacgaccaattgcacttgcggcgcttcggccagcgcgctttcgcgcacgttcatcagtaccgggcttttctccgctgccgcgagcagttcggtgcgcgcctgcatcaaggtcgcatggccgaggccgccgcgatcctgcaaacggaactcgaaaccactcgatgtgcccaggccatccacgggcggtggcagtaccgagaacgccatggcgtccttgatctcgctcaacgcgatattggcgcggtcggcaatcgagctggcggagtcatcactgccgcgctgcgaccagtccttcaaggtcgaaaacgccaaggctgcgttctggccgctaccggagaagctgaaaccgagaatcaccacactgtcgctgatccctggctcgccggcgttatgcgcctcgagctgttccgccacggccaccgtacgattcttggtcgcaccgggtggcagttgaatgtcagtgatggtgtaaccctgatcttccaccggcaggaacgaggagggcagacgcgcgaagcacagaccgagccccaccagcaggacgacgtagatcagcaggtatcggccactacgtttcagcgcatagccgacccagccctgataacgatcggtcaggtgctcgaagcggcggttgaaccagccgaagaacccggatttctcgtgatgttcacccttggcaatcggcttgagcagcgttgcgcacagcgctggggtcaaggtcagggcaaggaacgccgagaacagaatggacgtggccatcgacagcgagaactgttggtagatcaccccgaccgagccctgcatgaaggccatcggaatgaacaccgccaccagcaccagcgtgatgccgatgattgcgccggtgatctgcgtcatcgccttgcgtgtggcttccttgggcgacaaaccctcggtggccatgatccgttcgacgttttcgaccacgacaatcgcgtcgtccaccagaatgccaatggccaggaccatgccgaacatggtcagcacgttgattgagaagcccagcgccagcatggtcgcgaacgtgcccatcaatgccaccggcaccaccagtgtcgggatcagcgtgtaacgcacgttctgcagaaacaggaacatcaccgcgaacaccagcaacatcgcttcgcccaaggtgtagaccactttggtgatcgagactttgacgaacggtgaagtatcgtacgggatcttgtattccacccccgccgggaaatagcgcgccagctcatccatcttcgcccgcaccagcgtcgcggtgttcagcgcgttggcccccggcgacagctgcacgccgacggcggtggacggcttgccgttgaggcgcgtgccgaactggtattcctgactgccgatctcgacccgcgccacgtcaccgatgcgcacggtggagccgtcgcgattagccttgagcacgatgtcggcgaactcttgcggcgtcgacaactgacctttcaccagaatggttgcggtgatttcctggctggacgggtttggcaagtcgccaatgctaccggcagaaacctgggcgttctgcgcgacgatggcggcgttgacgtcagccggcgtcaggttgaaaccgatgagtttctgcggatcgatccacacgcgcatcgctcgctcggcgccatacagctgcgccttgccgacgccgtcgagacgcttgatctcgttcatcacgttgcgcgccagataatcgctgagcgcgacgtcgtcgagtttgccgtcactggacgtcagggttatcagcaggaggaaaccggaggagactttctccacctgcaagccttgctgattgaccgcttgcggcagacgcgactcgaccactttcaggcggttttgcacgtcgacctgcgccagctccggattggtgccaggctggaaagtcgccttgatcgtcgcactgccaaggctgctctgcgattcgaagtacagcaggtgatcggcaccgttgagctcttcttcgatcaggctgaccacgctttcgtcgacggtttgcgccgacgcaccagggtacacggcatagatttcgatctgcggcggcgcgacatcggggtattgcgccaccggcaattgcgggatggcgagcgcaccggccagcaggatgaacaacgcgacgacccaggcaaacaccggacggtcgataaagaattgcggcatggaaaagcgtcctgcttactgaccagaagtctgggcaagtggaagaggggtatcgtcgatctgcactttttcgccaggacgggcgtgctgcacgccttcgacgacgatgcggtcgccgggcttgagaccgccggtgacgatccagcgatcgttttgcaccgcgcccagttgcaccggttgctgcgccacacgcatttgctcgtcgacggtcagcacttgcgcgatgccggcgctgtcacgttgaacggcgcgttgcggcacggtaataccgttctggatcttcgcctgttcgatgcgcacccggatgaaactgcccggcagcagatcgaggtccgggttcggaaactcgctgcgcaagatgatctggcctgtgcccggatcaaccgtgatatcgctgaacagcagtttgcccggcaacgcatagagactgccgtcatcctgaatcagcgtgaccttgacctgatcctgaccgacctcctgcaactgcccggagcggaatgcacgccgcagttcgttgagttcgcgggtcgattgcgtgacgtcggcgtgaatcgggttcaactgctgaatcaatgccagcggcgtggtttcgttctgcccgaccagcgcgccttcggtgaccagcgcacgccccacacgcccggaaatcggtgcgacgacggtggcataccccagattcagtttcgcccgctcgacggcggccttgttggccgcgacgtctgcggcggtttgccgggcgttggcgcgcgcgttgtcgtagtcctgaccactgatggccttgtcgtcgatcagctgcgcgtagcgttgctcctgcagttttgcctggaaggcattggcttcggctttgcgcagcgcggcttcggcgctgtcgaggtcagccttgaacggcgccggatcgatgcggaacagcacgtcaccctttttcacgtcgctgccttctcggaaggtgcgctgcagcaccacgccggcgacccgtgcgcggacttcggcaatgcgcggcgcagcgacgcggccgctgagttcgctgctgatcgacaggggatgggcctcgatggtttcgatgcgcacggtggccggtggcgcctgttcctcggcgttcgaggacgagtcacaggcactcagcgtcagcgccattgcgatcaggccgagcccggccaacagtttgttcgacatttaccacccccaatattgatgcctgcatcctacggccagtggccgagagtagcggtgaagctttgtaggcgctgtgtgaaattgtgtaagggttttactcaggggcggctgagggcgtatatcctttagcccttgaaatttattgcgacagttgcatcgccatcgcgggcaatgtcgccactgcactttctggaacacctccatgcccaacatcctcctggtcgaagacgacaccgccctcgccgaactgatttccagctatctggaacgcaacggctattccgtcagtgtcatcggccgtggcgatcacgtacgtgagcgggcgcgggtcaatccgccggacctggtgattctcgacctgatgttgccgggcctcgatggcctgcaggtgtgccgcttgctgcgggccgactcggcgacgttgccgatcctgatgctcaccgcccgcgatgacagccacgatcaggtgctgggcctggaaatgggcgccgacgattacgtcaccaagccctgcgagccgcgtgttttgctcgcgcgggtacgcaccttgttgcgccgcagcagcctcggcgaaccgttgacggtcaacgatcgcatcgtcatgggcaacctgtgcattgatttgtccgagcgtaccgtgacctggcgcgagcaaccggtggaactgtccagcggcgagtacaatttgctggtcgtgctggcccggcatgccggcgaagtgctgagtcgtgaccagattctgcaacgtttgcgcggcatcgaattcaatggcaccgaccgttcggtggacgttgcgatctccaagctgcggcgcaagttcgacgaccacgccggtgaggcgcgcaagatcaagaccgtgtggggcaaaggttatctgttcagccgttccgagtgggaatgctgagctgatgtttcgcatcctgtttcgcctgtacctggtgacgatcatctcgtacagcgcggcgatctatctggtaccggacctggtggtcatggcattccgtgaacgcttcgtcacctataacctggattattcgcgcggcctgcaatcgctgatcaccaagcagtttcatgctgcaccgcacgaacagtggccggcgattgcggcgtcgatggacaaggatttccagccgttgcacatcgtccttgcgcgcatcgataacgccgacttcaccgcgatcgagcagcaacgactgcgccgtggcgaaaacgtggtgcgcatcggcgactggggctggcgcacgctggccgtgacaccgctcaatgacgatatggcggtgcaaatggtcgtgccgccggacccgatggacgtcaatctgttgtactggagcattaacgtgttgatcggcgcgagcctgctggcgtgcctgctgctttggttgcgcccgcactggcgcgatctcgaacgcctcaagggcactgccgaacgcttcggtaaaggtcatttgagcgagcgcacaaaaatcgcccagagttcgaacatcggcagtctggccaacgtgttcgacaccatggccggcgacatcgaaaacctgttgaatcagcagcgcgacctgctcaatgctgtctcccatgaactgcgtactccgctgacgcgtctcgatttcggcctcgcgctggcgctgtccgacgatttgccggccgccagccgcgagcgcttgcagggcctggtcgcgcacattcgtgaactcgatgagctggtgcttgagctgctgtcctacagccgcttgcagaacccggcgcaattgccggagcagattgaagtctcactggacgaattcatcgacagcattctcggcagcgtcgatgaggagctggagtcgccggaaatcgtcatcgacgtgttgttgcatggtcaactcgaacgcttctcgctggatccgcgcctgaccgcccgcgccatccagaatctgctgcgcaatgccatgcgttactgtgagaaacgcattcagatcggcgtgcaggtcagtggcgaaggttgtgagatctgggtggacgacgacgggatcggcatcccggacgatgagcgcgagcggattttcgagccgttctaccggctggaccgtagccgcgaccgggccaccggtggttttggcctgggtctggccatcagtcgccgggccctggaagcgcagggtggcaccctgaccgtggaatcctcaccgttgggtggcgcacgcttccggctatggctgcccactaccacctgaaaccactgtaggagctgccgcaggctgcgatctcttgatcttgaaaacaccctcaatagatcgcagcctgcggcagctcctacacgggtcagatcagttcgtttgactggatcagaccgaccccggccagttgcatgcgctcgattgctgctgccagtgatccctgcagatcgatcgcccggcaggcatccagcacgacaaatgcgttgaagcctgccgtgcgtgcatccagcgcggaaaacatcacgcagaaatccagcgccagtccgaccatatagaccgtgtcgatgccacgctccttgagatagccggcgagcccggtgaccgtcgtacggtcggcttccaggaatgccgaataactgtcgatgtccgggttgcaacctttgcggatcaccagttgggcatgaggcagattcagttccggatggaactcggcgccgggcgtagcccgcacgcaatgatccggccacagcgtttgttggccgtaaggcaactcaatcacatcgtacggctcgcgcccgggatggctggaggcgaacgaagcatgaccggcagggtgccagtcctgggcaatgatgacctgcttgaagtggccgccgagacggttgatcagcgggacgatctgatcgccttccggtacggccaactgtccgcctggggtgaagtcgttctgcacgtcgatgaccagcagcgcgctgcgcggtgaaatctgcatcggtatgtcctccttggataatcacgcgcacaggatagtagcaacggccgtcatgcgctcaatcgttcgatcaggtgtctggccagagcatcaagttccggcgccgggttatgcccgatcaacatccacgcatgctcgcgcgcggtccagtacaccacgttcatggcgtgtcgccgttcgtgagccagcggctggctgccgctgttggcgcgggtgacgcacagggccatcggcccatgtctggcatcgagataggtgatttgcgcgatcggcacgccgtcgtattcgagcaattgcgcgcgcttgagctccgcgccgggcagcctcagcgtggccggtgccaggctcaagcccaatcgcgcgtccaccgtgcgcaactgcgcgcgctgactggcttcgtctaccggcagatgatcgagcgtctgcgggacataaagcgccatgtagtcgccgacccgttcgcgccagctgtggtcttgcgccgcttgccagccgagcaacagccgatcggccaacacgccgccagccaccagggtggcggccgccgcagcgataaaccagcgtcggctcaggcccggatgttccggtgacgcaataccgtcgagccgagcctgcaaacgttccagcggcgcctgctgcgccagttcatcgtaggccgctttgtacggcagattgctgcggctcagccattgcacacgcaggctgagcagcggatcgtcggcgatggcactgtcgaattggctgcgctgttcgcggtcgagttcgtcgtctaggtacgcgaccagttgttcatccgaaggtgtgttcatgaccggtctccttcggtggttttcggcaccgcttgcagcggcgggtattcggcgagtttcaggcgtgcggtggccaggcgactcatcaccgtgccgatcggcacttgcaggatctcggcgacttcgcggtaggacaagccttcgacataggccagatacaccgtttcacgctgggtctcgggcaggacgtcgacgcgccgaatcacttgcgcagccagtacatgggtttgcgcggcgtattcaccatcgaacgccagatggccgtcggcatcgacctgtcctgcgccctgacgcacgcgccgcgcgcgcacttgattgagccagatcgaatgcaggatgctcagtagccagcgatccatgcgcgtaccggcgatatattgagcagaacgctccagcgcccgcacgcaggtggcctggaccagatcctcggcgacatgccgattgcgcgacagcagcagaccgtagcgccacaatcgcgccagatgctgtccgagttctgctctgaatgcctgatcgctgacgatgatggcctccgcttttgatatcaggttttcgatgagtcgttaatggcttgcgccaggtcctggtattcctcgcacgccgtgccgcagatcgactggatctgccgcaactgttcttgcgcgaggtcgacgcggcctttgatcacgtaggcttcgccgaggtattcgcgcacttgcgcgtattgcggatcgagtttcaccgattgcaggtaatagctgatgccttcgtcggtacgcccgagtttgcgcgtggcgtacccgcgataattcagcgccttggcggtgttcggctgtttcagcgtgtcgagcaacgccagtgcttcatcgtagcgacccgccttggccaggcgataggcgtaatcggtgcggtcggcatcgggcagcaggctgctggtctgcaatacgcatttttgcgttttgctgtcccagacctggcctttcgggcattcaggcttctgcaccggctcgtcttcgtcaccattggcgaaggccagatggctggacatggcagccgccagcagcagcggggcggcgaacataacggaacggatagtcatgggcaaggctccacagggggttatgtttcactttgaacaccacagggtgaaattttattcattgcttagtcagtgactgttcaagtcaggcacaaattccggcgctatgctcgcaagcgtctgccgttgatccgaagctctgcgataagggggactgccatgaacgatcatctgcatcattccactgggggctacaaaacggccgctgatacctacgtcaaagggcggccggattacccaccgcaagtcagtgactggctgaccacaacgctaggtctggatggtcacaagacggtgattgatctgggcgccggcaccggcaaattcaccggtcggttggtggccacaggcgcgcaggttatcgccgtcgaacccgtggcgcagatgctcgagaaactttctgatgcctggccgcaggtgttggccgtgcatggcacggcgaccgatttgccgctaccggatgcgtcggtcgacgtggtgatctgcgcgcaggcgtttcactggtttgccagcgaagccgcgttgaccgagatcgctcgagtgctcaagcctggcggcaagttggggttgatctggaacctgcgcgacacccaagtgagctgggtgccgaagctggacgccatcgttaatgcgctggaaggtgatacgccgcgttattacaccggcgaatggcgcaaggcgtttccgcacccggcgttcgggccactgcaattgcagcagtttcacaatgggcataccggctcgccggaggacgtgattttcaatcgggtgcgttcgaccagtttcattgccgcactgccggacgcacaacggacgaaggttgatgagcagatttgcgcgctgatcgcgtccgagcccgagttgcgcggcaaggatgtagtaacagtcccctacgaaaccgcagccttcgtgacacgaaaatccctgtaggagctgccgcaggctgcgatcttttgatctggtcttctaaaatcagcatcaaaagatcgcagcctgcggcagctcctacagggtggaatgttgcagtacatctcctcaagtcagtcccgcatttggccgaaccgccactgtgatgccttgttatagttcgggcctcattttcagcccggtaaaggatcactgccatgactcaatactccgctttcagcgtcgaactggccgacaacatcgcccatgtgcaaatcaatcgcccggaaaaaatcaactcgatgaacgcggcattctggagcgagatcgtcgagatcttccagtggatcgacgacaccgacgaagtgcgtgtagtggtgctcagcggcaatggcaaacatttttcctctggcatcgatctgatgatgctcgccggcgtcgccaatgaactgggcaaggacgtcggccgcaacgcgcgcctgctgcgccgcaagatcctcaccctgcaagcctcgttcaatgccgtcgataactgccgcaaaccggtgctcgcagcgattcagggttactgcctgggtggcgccatcgatctgatcgccgcgtgcgacatgcgttacgccgccgaagacgcacaattctcgatcaaggaaatcgatatcggcatggccgccgatgttggcactttgcaacggttgccacggatcatcggtgacggcatgctgcgtgaactggcttacaccggccgcaccttcggcgctgacgaggcgcgcagcatcggcctggtcaatcgcgtctacagcgacaaggacgcgttgctcgaaggcgtgctggagatcgcccgcgagatcgcttcgaaatcgccgatcgcggtcaccggcaccaaggaaatgatcagctacatgcgcgaccatcgcatcgacgacggcctcgaatacgttgccacctggaacgctgccatgctgcaatccaccgacttgcgcgtggccatggccgcccacatgagcaaacagaaacccgaatttctggactgagaaaccatgacagctcgctggaccactgcagtactcgacaccgatcaaccgggcggctgggcggttgcgcgcagcccggacggttttttgtttgatgacaacggcgcgctgttcccacgcgaatggctcaagcggcaggacttgtcgatcctcgccgagcacggcattggccatctcgacggcgagccggtgtatctgctcgaactgcgcagcaccagtgaggtgccgggttgcaactggaaaggcctgagagcgttcatgctcgatggcgatcacacgatctacaaagtgctcggttacgccgcgcagatcggcacgtgggctcgcgagcaccgtttctgcggcaattgcggccaggcgatgacgcaggtgccgcgcgaacgggcgatgtattgccagccgtgtgacttgcgcagttatccgcgtatttcgccgagcatgatcgtgctgatcacccgtggcgacgagattctgctggcgcgttcaccacgtttcgtcagcggggtgtacagcacgctggcggggttcgctgaacctggcgagtcggccgaggattgcctgattcgtgaagtgcgcgaagaagtgcagatcgaggtgcagaacattcagtacctgggcagccagtgctggccgttcccgcattcgatgatgctcggcttccatgccgaatatgccggtggcgagatcgtctgtcaggaagacgagatcgaagacgcccagtggttcaacgtgcacgacctgccgccgttgccggcgtccaagtcgattgcccgttacctgatcgacgtctacgtggcgcggcgcttaggccacgctgaaccagtgctgccaggctaggcgcacggtcaaacccagcaccacggtgatgaacaccgggcgaatgaacttggcgccaccgctgatcgcggtgcgcgcgccaaagaacgcgccgaccatcaccgacaggcccatgctcaggccgatgatccagtccacttgcccggaaaacacgaacaccgacagcgccgcaatgttgctgacgaagttcatgctgcgcgccacaccgctggccttgaccaggtcgatcgggtagagcagcaggctgctcactgtccagaatgcgccagtgccaggcccagccacaccgtcatagaaaccgaggctgaagccttgggtcgactgccatttctttttgatcggcgcatcgctgtccagcggtgctttgggcgtaccgccaaacaacagatacagaccgcaagcgaagacgatcaccgggagcatcttgttcagccattcggccggcaggtaatgggcgacgatggcgccggtcaatgcaccgatcagcgtgccgacaatcgcatgcacccactggcgtggatgaaacagcttgcggcggtagaaggtgaaactggcggtggccgaaccgaaagtcgaactcaacttgttggtgccgagcaccaggtgcggcggcaggccggcagtcagcaacgctggcgtggtcagcaggccgccaccgccggcgatggcgtcgatgaaaccggcaatgaaggcgacgatggccagaatggccagagtggtgaggtcaacgctgagttcgaaaggcatggaatcggcttattcggcagggcgcagatttggctgcggggagggcggtcatgttactcatttccaagtgttgctgcgacccgtctgacgccttcgcgagcaggctcgctcccacattttgaaatgcattccaccctgtgggagcgagcctgctcgcgaaggcattcttcatgccgaccccaaaccaactgttgtccacacaacaacccgccaacaaatcccacctctacaaaacatctgcaccacacaacaaacccaacaaaaccaggcattccaacctggcacgcttgctgctctaccactctcatctctcaaatgtcccgaggacacgccaatgagtcagcaagccgtaaaatttgcctactgggtgccgaacgtcagcggtgggctggtggtcagcaagattgagcagcgcacggattggggcatcgactacaaccgcaaactggcgcaaatcgccgaagccgccgggttcgagtacgcgctgacgcagatccgctttaccgccggttacggcgccgagttccagcacgagtccgtcgcattcagccatgcactgcttgcagcgaccagcaaacttaaagtaatcgcggcgattctgcccgggccatggcaaccggcgctggcggccaagcaactggcaaccatcgatcaactcaccaatggccgcatcgcggtgaacattgtcagcggctggttcaaaggcgagttccaggccatcggcgagcattggctggagcacgacgagcgttatcgccgttccgaggagttcatccgctcgctgcgcggcgtgtggagtcaggacaacttcacctttcgcggcgatttctaccgtttcgataattacaccctcaagccaaaaccgctgggccgtccggagatttttcagggtggcagctcgcgggcagcacgggacatggccgcaagggtctcggactggtatttcaccaatggcaatagcgttgaagggatcaaggcgcaggttgacgatattcgcgccaaagcgacggcgaataaccattcggtgaagatcggcgtcaacgcgttcgtcattgctcgcgacaccgaggaagaggcgcgggcagtgctggcgcagatcatcgatcaggccgatccggaagcggtgaatgcctttggcgacgcagcgaaacaggcgggcagggcgtcaccggagggagagggcaactgggcgaaatcgacgttcgaggatctggtgcagtacaacgacggtttcaagaccaatctgattggcacgccgttgcagattgccgagcggattgtcgcgttgaaggcggtgggggtggatctggtgttggcggggtttctgcactttcaggaagaggtcgaatatttcggccggcgggtgttgccgctggtgcgcgagttggaggccgaaaagaccgctgccgtcgcctgaaccccacacatcccctgtaggagtgagcctgctcgcgatggcgtctgaacattcaacttataggttgactgacacaccgctatcgcgagcaggctcactcctacagttggagctgtgttggcttacagaccgaggtcagacaggcttgggtgatcatccgggcgccggcccagtggccagtggaacttgcgttcgctttccttgatcggcatgtcgttgatgcacgcatagcgctggaacatcaggccctgctcatcgaattcccagttttcattgccataggagcggaaccagttgcctgagtcatcgtgccattcataggcatagcgcacggcgatacgcgtgtcggagtacgcccacagctctttgatcaaacggtaatccagctcttttgcccacttgcgggtcagaaaagccttggcttcttcacggttgttggcgaactcggcgcggttacgccattgggtgtcgagggtgtaggccagcgatacccgttccgggtcgcgggagttccagccatcctcggccagtcgaactttctcgatcgccgattcacggctgaagggcggtaatggcggacgtacctgggctgcagtagacatgttcagtctcccgatctaattaataattgaacaacaagtccggcttattaaggcattacaggtccaataactttcgcgccatgcattgcgcattatcggcggcactgtgatcacccatcacaagcgctacggtaatggcaccgtcaatcaggatcagcaactgtttggccagcagttgcggatcctcggcaccatgttcggtacacagctcgcacacgtagtcgagcagcttctgtttgtgttctttggcaaccaaccgaacggggtcttgcgggtcgccggtctcgccgctggtattgatgaaggcgcagccgcgaaagccttccgaggcgaaccagcctttgagcacggtaaacaggttgagcaggcgatcggccggggtttcggcctgatcgacggcgcttctgtaccaatgcatccagcggatgtcgcggcgttgcagggcggcgacggtcagtgcgtccttgtcggcaaagtaacggtagatgctttttctggagacaccggcggttttcaccagaagatccatgctggtggcagcgatgccacttttgtagatcagcttttcggtgacgtccagaatgatgtcgcgcgtgtcgttgctagtgatttcgttcatgtggcaaacagtagaacgattgttctcctttggcaatggttttttagggtcaacagatcgcagccttcggcagctcctacattggcccgtgtaggagctgccgaaggctgcgatcttttgatctctttacgggcactaacaagacccgaaggatgtgatggtgtaagctctcaggctcttcggattcgacccattgcgagccctatgccgttgcttttcaaacgttccttgctgcccaaactgcgcagctttccgctgaccgccgaggctgtgaccattctgtccggcgccgccgagttccgtcgttgcctgctggagaaaatcgccgcagcgacccaacgcatctacatcgtcgcgctgtacttgcagcaagacgaagccggtcaggaaatcctcgatgccctccacgccgccaagctcaagcgtcccgagctggaaatcgccgtggtcgtcgactggctgcgtgcgcaacgcgggttgatcggtgccggcaaacagccgggcaattcggcgtggtatcaggaaatgacccgcacgcacgaaagcgaagtgccggtctacggcgtgccggtgcagacccgcgaactgttcggcgtgctgcatttgaagggcttcgtgatcgacgattgcgtggtctacagcggtgcgagcctgaataacgtctacctgcacaagttcgacaagtaccgtttcgaccgctaccacgtgctgcaaagccatgagctggcggactcgatgcatcatctggtcaagcatggcttgatcgagtcgaaagccgtgcatcgcctcgatctgcctaacctgccgaccacgcgcagcctgcgcaacgacatcggtgatctgcgcagccgtctcaaatacgcgacatacgacaccgcaacgggcagcaccgcccgagacggcttgtccgtgaccccgttgctcggcgtcggcaagaacaaccccttgaaccgggcgattcttgagctgatcgccagcgcgcaaaagcagctgaccatctgcacgccgtacttcaatctgccactgggcgtgatccgcgagatcaatcgcgcgttggcccgtggcgtgaagatcgacatcgtggtcggtgacaagactgccaacgatttctatatcccgccgagcgagccgttcaaggtcatcgcggcgctgccgtacctgtacgaaatcagtctgcgccgcttcgccaaacggcatcagcgcaatatcgacagcggccagttgaacctgcatctgtggcgtgatggtgacaacacctatcacctcaagggcatgtgggtcgatcagcgctatacgctgctgaccggcaacaacctcaatccacgggcgttccgtctggatctggagaatgcgttgttgattgatgatccgaagggggagtggctggcgccgcgagcgaaggagctggaagagattttccgccataccacgcggatcgacagttttcagaatctggagacgctgccggagtatccggccggggtggccaagtttctcaagcgcgtgagtcgggtgcggattgagcggttgctctaccggatactttagcgctgctgaaaatgccatcgctggcttgccagcgatggggcccgcttagacgctacaaaaaattaattcagccccaacttgccacgcaacgtggacaggtcttccgccagcgtattcaccggcccaaccagcgctttacggtcgttatccttcaccttgtcataggtttcaaacccaccctccttggtcttgtacttggccagaatcttgtcgacggtggcaaagttcttgtcgaccttcgcgacaaaagccttgtcttgcttttcgatctgcggacggaacagatcaacgattttcttcgcaccgtcgatgttgccctggaagtcgtagaggtcggtgtggctgtagcgatcttcttcaccggagatcttggtcgcggcgacttcttccaacagtgcagcagctccaccgacgactttttccggtgggaacgtcaggccggccacgcgggtttgcaggtctttgacgtcgctgttgagcttgtccgccaactcgttcaagccttgggtgcttttctctgagaacagcgtgtattcgatgcggtggaaaccggtgaagtcttcagctttcacgcctttctcgtggtcgtcgacgcgggagtcgatggaggcatcgaggtcactgaacagttcggcaatcggctcgatcgactcgtagtaaacgcgggtcggtgcgtagagtttttgtgcggtggccaggtcaccttttttcaccgcgtcggtgaactgctgcgtgtggctgcccaactcatcgagttgttcggtgacgtaaatcttgtagtccgacaccggcccgaccagatccagcggtgccgtggcggcaaacgctgacagcggggtgttgagcaaaccgagggttagcaataacgcgagtggcgtctttttcatgggggcggctccagtgttgggattgttctatgcagctgttttcggttgtgtggcgttaagcagcgagcgaccgatgaaatccttgtcgcccgtgacacccggcagggtgaagaagtaaccgccgccaaccggtttgaggtattcctccagcggctcgccgttgagacgggtctgcacggtgatgaagcctttttccaggtcggcctggtaacagatgaacagcaggcccatgtcgagctgaccgttcttgttcacgccgttggaatagttgaatggccggcgcaggatcaggttggcctgagtcgcagccgtgcgcggattagccaggcgaatgtgcgcgtcgagtttggtcagtttgccttcggggtctttgcggtaatccggcacttcggtttcatggctgccgccgataggcgcgccggaggttttcacccggccaaggatgctttcctgttcctgcaacggtgtgcgatcccagcgttcaacgaagttgcggatgatccgcaccgcttgatagctgccatgcgcggcccaggccggttcatcgctgcccgcttgcacccagacgatgctgtccatggctttggcatcgttggagtccgggttggccgagccgtcacggaagccgaggaaattgcgcgccgattgcgccggcacaccgggtttcgccggggcttgtggcggcacgctgccttcctgtttccaacgcaccagcagcaggtcggggaggtttttgacgatgtcacgcagggcgtggatgttggtgtcggtggtgttggagcaaaactgcaaactcaagtcgccgtggcagcagtcagcctccagcgcatcgttggggaagccgaccatgcggatcaggcgttttggcttggcctcggccagaccgaagcgctcatcgaacaaggattcgccgacggagacggtaatggtcaggttgtccggcgtcacgttcgggccaaggatgccggagtccggcggcggcagtttcgggtcgatctgtgcgaccgggccgcccttcatcagaaacgcaatgcgctcgttgagcgtgcggaacaaccgctcgaggtcttcgcgatcactggccagcacgtcgaacgacaccagcatgccggaggccgggcgcggggtgacgatgccggtctggtgcacaccgtggaaatcgtggtggtcttgggtcttgtcgctgctcggtgcttcggtgacttgcgccggcgcggcggccatggccgggcagctcagggctgagccggcaagggcgacaccggcggcgcccatgcccatcaggacacggcgacgttgcaggttgaggttttctgattctttcatcgcgaattcgtcttctgcttacaggccagagaggccgagggcgggatcgatgccatccagtgcgtcggccagagcctgggccttgtcggcaatctgcttgcgttgtgcgccgctgacggagtcgtagctggcgtagccgtccttgatcttgaaactatccagcgtggtatcgaaatcggtcagcgcagcgtcgattttcggcagcagatcggcggcggatttgctcagcattggccgcagcagatcgacgactttgtgcgcggtttgcgcattggcggcgaaaccgttgaggtcgctgtggctgtagcgttcctcttcaccactggcggcgcgcacgtcggccaatgtgttgaggttgcgcacgacgatgttgaccagttgctcgggtggcaggctctgcgcgagcagttgctgtttgagcgcggtgacgtcgctgagcaggcgctgggcaaccggtgccagatcgtcgagtttgcgctgctggaacaggccgaattcaaggcgatggaagccgacgaaggctggatcctgctcgcgtttttcgaagtaatcggcgcgggcgttgatgctgttgtccagttctgccagacgctgcgcagccggggccagatgttgataggccgcacgcgcgggcaagtacagcgcctgagcctgactcaaatcgccgctttcaatggcttgattgagtgcggtcacggctttgatcagcgcgctgctctggctggccagatacacacggaattctgacaacggtccgacgaaagcgaccatcgatggtttggccttggccgccgcgtcagaggctgccgtcggcgtcacatgcagggtgccgcgtgggttgctgagcaatccgcaggtgatcgcgtaatcgccgggttgcagattggcgttgatcacctggctcaggcccggcgcgatgttttcgcgctcttcgacaaccagcacaccgtcgaggatttcccattccaccgcgcggtcggagcggttgacgatgcggaaactggcgcggccggccggcacggtcagcgcattcggctcgcaactgcccgggtgaatgttcaccaccacttcgtcgtgattgtgctgacgtttggccgcggccattttcgaggcgtaccagaacaggccaccggcggcgatcatgatgaccaccgaaccggccaccgcccagcgcaaggcacggggaggggaggcctgaggagtattaggctttgacatggatgcccttattggctggaaacggaagacgattgcgcggagggcttgggggcgggagccggataaaagaacatcaccagcgccaccaccaggtaaatcagatacgccccgagtgtgctgacggtcggcgcatcctgataaccgaacatgccggccagcaccgagcccagcgggccgtccatcggcagcgtcgcgctgaagtcgaacagcacggtctgcaggtgattccacagcccggcttcatgcagggcttgcacggaattggcgagaatcccggcggccaccaccagaatgaacaggccggtccacttgaagaacgccgaaaggttgaggcgcatgctgccgctgtagatcaggaagccgacgatgatcgccagaatcagcccgagcagggcaccgatcggcgcgcccgggccttcgctttgctggaacaccgcgagcaggaagaacaccgtttccagaccttcgcgagcgacagcgaagaagaccatggcgatcagcgcaatgacctgatgcttcgaagaggtcagcgcgtgatccagcgaggcttgcagcgaatgcttgatcgaacgcgcgaccttgcgcatccagaacaccatggagctgagaatgcccacggccaccaggccgacgatgccttcgaacagttcctgctgcttttgcgggaattcggcactgaccagttccagaccgccaccgaccagcagagcgagggcggcggcgaggaatacgccgatccacacggcgggcatccattggccacggccagtctgttgcaggtagctggcgataatgccaacgatcagcgcggcttcaatgccttcgcgcagcatgatcaggaagggaacgagcattcggtatccaacaagtcattcgaagaggttacaagttgtaacataatgaaagtcattctcacatgacattcattgacataaacctgaacagttgctgaacgacctcaatttttgcctcgcattgatccttgtaggagtgagcctgctcgcgatggcgtcgtatcagtcagcgctgatttttcagacccagcgctatcgcgagcaggctcactcctacagggggttcgtgttgaattcgccacctgcggtaagatgcccaccactcaaaaacaacaaggttcaccgcgctccatgtcggaaaaagacaccatcgccgttcaactggtgcgtgaagcgctgctgcagagttgtgccttgggcgtggccaccgacgaagtcttgagcaaggtcggcattgcgccggcgttgctgcaaaccgcgcagggtcgggtgccggcctcgcagtacgcgaaactctggcggttattggctcggcgtggcgatgacgagtttttcggtatggacccgcgcaagctcaagtccggcagcctcgaattcctctgtcgcagtgcgatggcgcaaccgacactggcagcgggtttgagcacggggttgagttttctctcactgatgctggagcgcatgccggcgcaactggtgcaccagcaaagtctggcggaaattgtactgctggaggacgacgccgaaccgcgccgcgctttcacctatttcacctattggatgattgtccacggcgtcgcctgctggctggcggggcggcggattccgattctggccattgaattgcgttgcccagagccggatttcaccgatgactaccgggtgatgttttccgaaaacctgcggttcgatcggtcacgcacgcggatgatcttttctgccgattgccttgatctgccgatcaaacgttgcgccgaagagttgaagcgctttctggcccatgcgccggccaacatcctggtgaagtaccgcgacccggaaagcctcgccagtcggatcaagcaggatctgcggcaattgcccgctgaacgatggccggaaaccgaggcgctggcgcaacagttatgcatgtcggcctcgaccttgcgccggcgcctggccgaggaagggcagacctatcaaggcctcaaagacagcgtgcgcaaggaattggcgattatctggctggcggaaccttcgatcagttttgtcgagattgccagtcgattggggtttgccgatgcgagttcgttctataaggcgtttcgcaagtggtcggggtcgaatcccggccactaccgcacgctgatcctgaatgaggttgtctgatccaacacatcccgacgcttgatcgttcccacgctctgcgtgggaatgcctcaagggacgctccgcgttccaagcacgccgggtttgtgcaggagttcttcgagcttcaggtcggggcgggcgctgacgagttcgaggtcgaaacggaacggttcattgagggcttcgcgaccggtgaagctgaggacttgcagatcggcgttggcgccttcgagcgtgagggtaatgtgtgttgcgttggcgtccagcatgccttgaattccgtccgttgaataagcagggggcggatgttgcaggattaagccgcctcgttcaaggcgcaaaagccgtatgcgcgggcaacaggtggtatagggaaaacccctagatggcgcgtttcacccaataaaaccgggcatttgataaagtctgaagccagcctgtgacgatcattcctacaaacgaagattgaagaatcgccagtcagattcagactaaagtcgcctgtagcacgtcaaagccatctgccatcattgccgttcatccccgcgtggttctcttcctcccggcttattaatgagctgggacgggagctatttttcgtttgttgcgcgcttgcgcaaacgctgcagtgttggagtttttcatgcgtcccccattttccctcatcaccccgcgccagtcgtttggcttcggagcctttgtgctgtgcgcaggttttaccgcacaggttcaggccagcggattccttgaagacactacggcgaaaatcgaatcgcgcacggtgtatttcaaccgcgatttccgtgatgggcacacctcaagcgatcagggcgcttccaagcgtgaagagtctgcacagggctttattctcaacctgcaatcgggctacaccgaaggcacggtcggctttggcattgatgcactgggcatgctgggttttcagctcgattccagcccggatcgcagcaacagcggcttgctgccatcgagcggcgagaacccgcgcggttcgaaaggccagtacgcgaaaatgggcctgaccgccaaggtcaaggtctcggacacagtgctgaagtacggcgcgctgttgccggatctgccattgctgaaatacaacgacggtcgtttgctgccgaccatgttcaatggcgcgatgctcacttctaaagaggtaaaagacctgaccttcatggccgcgcgcctggacaagtacaccgcacgcgactccaccgattcgcaagacattcgcgtgcactgcaagaacaagcgctacgcgtgcaataccaccgccgatcatttcgacatgtatggttttgactacaagatcaatgatcgcctgaccggccaatatcactacgccgaactggaagacatctatcgtcagcatttcgtcggtctggtagccaatcagccaatgggtggcggtgtgttgaaggccgacttgcgcttgctgaagagcgccgacagtggcgatgcgaaagccggttccatcgataaccgtgccttgagcggcatgctgtcctatgcgcacagcggccacacgttcagcgccggttggcagcgcatgaacggcgacaactcgatgccgtacctcgatggcagcaatccgtatctggtcaactatgtgcaggtcaacgacttcgccgccgcgcaggaacgttcctggcagttgcgttatgactatgacttcaaggccatcggcatcaatggtcttagtttcctgacccgttatgtgaacggtgaccacatcaaggtgctgggcagtgatcaggaagggaaggagtgggaacgcgacagcgagttgaagtatgtgattcagacgggcacgttcaaggatgtgagtgtgcgtttgaggaatgctacgtatcgcaccaattacgagaagtttgcccgggatgtggatgagactcgggtgattgtgagttacaacttttcggtgttgtaggtcctggatgtgtagtgcttgatcgggcgctatcgcgagcaggctcactcctacaatggatcaatgttgaacgcgatatccgcgtccgctgaagatcccctgtaggagtgagcctgctcgcgatgaggcccttgaaattgctgctataaccaatgccagaaccggctccagaacccgcgattcaaatcctctttgcacccggcatattgccgcgcatacacatccgagcggttctgcactttgcgcgccgtcggcatcagccacgctttgctggcgtaagtcttgttgcggaagccgccccagccttcgtggtagttgaggtactggttataggcgtcgtacttgtagacgccgttgatcgaataggtcttgtccatgtaccaaccgacaaagtcgatggcgtcgtcgaagtcttcgcgatcggcgccgctgcgaccggtgcttttctgatagtcggcccagacttcatccttggcttgcgcatagcccgatgcggtggacacacggccccacgggatcacccagagcaagtatttgcgcggagtcttggcgtcgtagcggtagccggattcctgatacatgatcgcgaagggcacctgaatcggcacgccccagcgtttttgcgtgacttgcgccgcgtcgtaccagtcgcttttctcgcggaaaatctcgcagatatcttctggcgagcggggcggcgaggtgccgcacccggtcagtagcgttgccagtgtcagtagtcccagcgtctgcccgtatttcaaaagccgttatcccgtcgtgcgcaaaaaggccgacagtctacggcctagctcaattggtgacgatagggcagatccggaccagtcttgctgcaggtcagcgcagcggcttgcacggcgaacttgagcatggcgtcgatctgctcgcgggcgagttgttgcacgccttcgaccgaatccagcccatgctcggtcagccaggtaatcagcgcggcctggaaggtatcgccagcgccaacggtgtcggcgattttcaccgaggccgccggcacagaccagctgccgtggtggcggctgaacacgctggcgccgtcgccgccacgggtgaggaagacgatctggcagcgctgttcgagccagccttcgatcacccgttgcgggtcctgttcggggtagagcaggctcaggtcttcgtcgctgaccttgatcagatcggccagtggcaccagcgtcgcgatgcgctcgcgccacaggtcgatgtttggctcgggattgaggcgcacgttcgggtcgagggtgatcaggcgcttgccactttcacgctgcaccaaggccagcagcgtatcgccaataggctgcaccaccagcgagaacgaaccaatgtgcaagccgcgcacctcaggacccagcactggcagatgcgcaagactcagttgccgatcggcacagccttcgccacgaaagctgtagtgcggcgagccattggcaccgacggcgaccattgccagcgcagtcggcgcggcgaagtccaccagatagtccgggcacacaccttcattctgcagcacttgctgcaagcggcggccgaggtagtcggtggacagtccgccaaacaaggccgagtccacgcccagacggcgcaaaccgacggcgacgttgaacggcgagccgccggcaatcgccttgaaattcactttcgaggccagaccgctggcgtcgtcttcactgaaaaaatcaaacagggcttcgccacacaccaaatacataattgtttgctctttatagggtcgcgacatgctgttgatagcgttcataggcctgctgaaacgccgcaacgttggcggcaatcggcagggtttcgctgcttggatcgagtttcacgcagcgttggcacagctcggcgaggctgtcttcgtggccattggaccaggatttgcaccacgccgcttgaatcgccgcgccgagggcggcggcttcgctttgttcggtgcagatcaccggagtattcatgatgtcggcgacgatctgtcgccataccgcgcttttcgaaccgccaccgatcaggcaaatgctgcggctttgtaaaccattgtggcggagcaaatccagtccgtaacgtagaccaaaggttgtgccttcgacggcggcgcggcacagattggcctgggtcaggttgtccagcgtcaagccgtgcaggctgccggtggcatgaggcagcgcaggtacgcgttcgccgttgagaaacggcagcatgctcacgccgtcggcgccgatgggtgcctgggcgacgaggtcgttgaactgctgcagatcaaggtcgaacaattcgcgaatcgcgccggtggcgttggtcaggttcatggtgcagatcagcggcaaccagccgccgctggacgagcagaaggtcgcaaccgaagcgtccgggctgactttcggtgcgtcggaataggcgtacaccgtgccggaagagcccaggctcatggtgatcgcgccgggctgaatattgccggtgccgatggcgcccatcatgttgtcgccgccaccactcgatacctgtgcgttggggttgatgccaaggtgtgcggcaatcgccgggaggatcgcgccgacggcttgatgcgcgtcaatcagctccggcaatgccgcttgcaggcgtccgctggcgtcgatgtcgcgcagcagttgcaagtcccattggcgggtgcgcacattaaaatagccagtgccggaggcgtcgccgtattcgctgcaggcgcggccggtgagccagaagttgaggtagtcgtggggcagcagaatgcgcgcgatgcgtgagaacaccacgggatgctgttctttggtccagagcagtttcgacacggtgtagcccggggcgatgaccacgccgaggcgttccaatgagcctttttctccgcccaggtgaaccagcaaacggtcgttttcggcgctggtttcggtatcgcaccagagcttggccgggcgcaggacttcaccttgatcatcgagcaggaccagaccgtgttgctggccggagacgccgatgccgaggatcgactggccgtcgacatttgccgccagcaacgcttggcgggtggcgagggcgaaggcttcgagccattgctgggtgtcttgctcgcggcggccattcgcgccgctgatcatcgtgtgtgcggcggcgccttgtcctagcacctggccgctggcggcgtcgaggatgatggctttggtgccttgggtgccgcagtcgatgcctaggaacagttgttgttttgtcattagcactccaggaccgctcgttcccacgctctgcgtgggaatgcctcattggacgctctgcgtctgctgttggatgggacgcggagcgtcccgggctgcattcccacgcagaacgtgggaacgatcaggctgcgagaatcttttccagcgtccgcgtcacaccgtcctcgcgcaaactgttgcagcaccactcaaacgccgccacaaactccgccgaacgcggtatcgccgtgccaaaaatctcttcgaccgccaacaaccgctgagtcattaaagcatcgtccgccaccaacgcctgacaaaacgccgcgcgcggatccgggatcgaataggtatcaccattctcatccacgcctttcaaatacaacgcccacgccgccaccaccaacgccgcacgtttagtctcctgcccatcggcaatcaaccggttgatcgtcggaatggtgaacttgggaaacttcgacgaaccgtccgagcacacccgctccagttgatcggcaatcgcctgattggagaaacgcgccaccagcgtgtttttgtaatccgtcagatcaatgccgggcaccggcgccagttgcggggtcacgtccagatccatataggcgcgcatgtaacgcacgaacagcgggtcgttcatggtctcgtgaacaaaccgatagcctttcaaaaagcccagataggtcagcgccagatggctgccgttgagcagtttgattttcatctcttcgtacggcgaaacatcgtcggtgaactgcacgccgaccttttcccaggccggccgaccgttgacgaatttgtcctccagcacccactgcacaaatggttcgcagaccaccggccaggcatcgtcgaccccatgtttgtcggccagttgcaggcgatgggcagtgctggtcatcggcgtgatgcgatcgaccatggcgttggggaaactgacgttggcgtcgatccagctgcacagatcgctattgcgcagagaggcaaacgccagcagcgccttgcgcgtcacggcgccgttgtgcggcaggttatcgcaagacatcacggtaaatgccgggatgcccgccgcccggcgtttttccaaggctgcacacaaaaagccgaacacggttttcggtgcctgcggattggccagatcatgttgaatttgcggcaggtgcgccatgaactcgccgttgctgtcgtcgatgcaataaccgccttcggtgatggtcagcgagacgatgcggatctgtggggcggcgagtttgtcgatcaacgcctgagcgctgtcttcggcgagcagcatgtcgcgaatcgcgccgatcacgcgcacctcggtgttatcgctgtcgccgagttcgaacagggtgaacaggtaatcctgttccttgagatcatcgcgggcgcggcggtcttcggtgcgcaggccgacgccgcaaatcgcccagtccagcgcttcgccggtgttcatcagcgcgtcggtgtaatacgcctgatgcgcgcggtggaagccgccgacgccaatgtgggcgatgccctgacgggtgtcgctgaggctgtaggccggcagttgcacttcggcggccagacgatggaggttctgttggttgagtttcatcgggagttctcgaaatcaggccgcagcgcgcagcggacgggtcagcgcgacaccttcggcatcgaataaatggcagtgcgtcgggtcgaggtgcaggctcagttgttcgccgtagcggcttgccagatcaccgcgcacgcgcatggtcagggcttcgccggcattcgtggcgacgtggcagaaagtgtcgctgccgaggcgctcgctgacgtcggcggtgacttgcaacgtgcagtcgccggcttgcgccagttccaggtgttccgggcggatgcccagggtcacggcgctgccgacgctgaggttgacggtgttgaacggcaaggtgatgcgcgttccggcgtccagcgaaacctcacagctctgggcgtcgaggcgggcgatcttgcccttgaggaagcccattttcggtgtgccgagaaaaccggcgacgaacaggttcgcggggttgtgatacaggtccagtggcgagccgacttgctcgatcttgccgccattgagcaccacgactttgtcggccatggtcatcgcctcaacctgatcgtgggtcacgtagatcatcgtcgcctgcaggtctttatgcaggcgcagcagttccagacgcatctgcacgcgaagcgcagcgtcgaggttggacagcggttcgtcgaacaggaagattttcggattgcgcacaatggcgcggccaatcgcgacgcgctgacgctgaccaccggagagctgctttggcttgcgctcaagcatcggaccgagttcaagaatgcgcgcggcctcgccgactttcttctcgacttcggctttcggtacgccggccagatcgagggcgaacgacatgttctttttcacggtcatgtgcggatacagcgcgtaggtctggaacaccatcgccagatcgcgcttggccgggctgacttcggtgatgtcgcggccatcgagttcgatggtgccgccgctgacttcttcgaggccggcgatcagccgcaacagggtggatttgccgcagcccgacgggccgacgaagactacgaattccttgtcgttcacctcaaggtcgatgcccttgatgatggagaaaccttcgaagcctttttgcagattcttgattttcaggttggccatgaggatgggcctccgcaatgttgtttttttaagatcaaaagatcgcagcctgcggcagctcctacagggggacggcatgctttatgtaggagctgccgaaggctgcgatcttttgcttttcaatcttcatttcacggcgccgaacgacaggccgcgcaccagttgtttctggctgatccagccgaagatcagaatcggcgcacacgccagggtcgagaccgccgacaacttggcccagaacaatccctcgggacttgagtacgaggcgatcagagcggtcagtggcgcggctttcgacgaggtcaggttcagcgaccagaacgcctcgttccagcacagaatcagcgacagcagcacagtcgaggcgaggccacccttggcgatcggcaacagcacgcggaccatttcctgccacaacgtcgcgccgtcgaggcgggcggcttcgaggatgtctttggggatgtccttgaagtaggtgtaaaccatccagaccacgatcggcaggttgatcagcgtgtagatcacgatcagtgcgatgcgcgtgtcgagcaggccgaaacttttggccagcaggtagatcggcatcagcacgcccaccggtggcagcatttttgtggagagcatccacagcagcgtgcctttggtacgctgggtttcgtagaacgccatcgagtaagcggcgggcaccgcgatcagcaggcatagggcggtggcactgaaggagatcaccaccgagttccaggcgaagctgaagtaatcgctgcgttcattgatgtgcaggtagttctccagcgtcggcgtgaagatgaactgcggcggcgtggcgaacgcgtcgatttcggttttgaaactggtcatcaccatccagaagatcgggaagaaaatcacgatcgcgatggcccaggccagggtgccgagcagcaggctttgcagccggcgggattgttgaagagtcatggcaggcctcaggctttgtcagtcaggtttttgccgatcatccgcaccagaatgatcgcggcgatgttggcgatgaccacggcaatcaagccgcccgccgaggccatgccgacgtcgaactgcaccagcgcctggttgtagatcaggtaggcgaggttggtcgaggcgtagccggggccaccgttggtggtggtgaaaatctcggcgaacaccgacagcagaaagatcgtttcgatcatcaccaccacggcaatcggccgcgccagatgcggcagggtcatgtgccagaagatcgcgatcggcccggcaccgtcgaggcgcgccgcttctttctgttcctggtcgagggactgcatcgctgtcatcagaatcaggatcgcgaagggcagccactgccacgagacaatgatgatgatcgacagcagcgggtagtgggcgagccagtccaccggttgtgcgccgaacaacttccagatgtaggcgaggatcccggagaccggatggaaaatcaggttcttccagatcagcgcaccgaccgtgggcatgatgaagaacggcgagatcagcatgacccgcacgatgccgcgcccgagaaattcgctggcttcaagcaatgcactgatcaacacgccgaggaccacgctgatcagcagtacgctaccgaccagcagcagtgtattggtggcacccggcatgaagcccgagtcggtcagaaagtagctgaagttttccagcccgacgaattcgttttccccgggatacagcaggttgtagcggatcagcgaaaagtagatggtcatgcccagcggcacgatcatccacagcagcaacagggccaccgaagggctgaccagaaaccagccggggttgcgtacgcggaccttgcgcgcaggttgcgacaggtcgaggtgggctttggcagttgaagtattcatggtgatcacaaccgagtcatacagacctatggagatctaatggaggagtgagcctgctcgcgatggcggtgtgtcagtcaccgtctgtttcagattgaaaaccgccatcgcgagcaggctcactcctacaaaaggcaggagcgagctttgcgggttacttgggatacccggcgcgcttcatctcgcgttcagtggattgctgagcggcggcgagggcttgatccaccgtggtctggccgatcagcgctgccgaaaacagcttgccgacctgggtgcccacggcctggaattcaggaatggtcaccagttgaatgccaatgtacggcaccggtttgagcgtcggtttgcccggatcggcagccttcagcgattccagcgtgaccttggcgaacggtgctgcgctcatgtaggcgtcgctgtaggttgaggcgcgggtgcccggtggtacgttggcgataccgtcagtcttcgccaccagttcgccgtactctttggaggtcgcccaggcgctgaactctttggcggcatccttggctttggagctggtcggaatcgccagcgcccacgagtacagccatgccgaacctttgtcggtgacctgatgcggggcgaaggtgaagccgacgtgatcagcaaccttgctctgggtcttgtcggtgacgaacgaaccggcgacgctggcatcgacccacatcgcacatttgccgctgttgaacaaggcaaggttttcgttgaaaccgttgctcgaagcacccggcgggccggatttcttcatggtgtcgacgtagaagttcagtgcgttcttccactcggggccattgaattccggctgccatttttcatcgaaccagcgcgcgccgtaggcgttggcgacggtggtgatcagcgccatgttttcgccccagccggccttgccgcgcaggcagatgccgtactgttctttatcctttttcgtaagcttttcggcgaacccggcaatctgttcccaggtcggacgctcgggcatggtcaggcccgcatccttgaacaggtcggtgcggtaataggtgatcgagctttccgcgtagaacggcagggcatacagcgagcccttgaccgaaaggccttcgcgcaccgatgggaacacatcgtcgagggcgtaactggccggcagatccttcattggttcgagccagcctttggcgccccacagtgccgcttcgtacatgccgatggtcaacacgtcgaactgcccgccctgggtggcgatgtcggtggtcaggcgttggcgcagaacgttttcttccagtaccacccaattgagcttgatgtccggatgctcggtctcgaaagttttcgagagcttttgcatgcggatcatgtcgctgttgttgacggtggcaatggtcagagtctgggcgccaaggctgacgctgctgagggtcatgcaggtgagggcaagcagagcttttgcagtgggttgcatcgtgcactccttttctgcgcccggtgggtagcagaaggacagttattgtttttgtgtcttccgacgacaggaagaatgtgcactgattacagccttcaatcacagggctgacaaatcatccctagcacttttatcgatacttttttgcactggtgtttggcagtgtaaacgcagggaaggggttttcagcggtcagacgctatcgaatgcgtacaggtttctgatgccgacgcagccctctgtaggagtgagcctgctcgcgatagcggtgtgagagtttgcagatatgttggctgacactccgctatcgcgagcaggctcactcctacaggggaccgggttgtcaggtgtggttttgttcggtcaggcgctgcactgcgagccgacggtaatgcgatggcgtcatgcctttgagctgcaggaagcgccggttgaaattggaaatgttgttgaagcccgattcgaaacacacctcggtcaccggtttgtcgccatcggccagcagctcgcaggatttactgatacgcaggcgattgacgaactcgatgaagttgcgccccgtcgcctgcttgaatacgcggctgaaataagtcggcgtcattgcgagatgttcagcgacttcctccagtgctatatcgcgggcgtaatggctgaatatgtaatcgaccgcgcggttggtccggtcgatgttgtgctcgtcggcgagttgcacagtggttgcgcctgacaaaagctgaaagtcatcgctggctgcgagcagctccatcaggatgaaaaaatgccccagccgggtgatgcctgtggagtcggcaatacgctgcatcagcgtcatcgcctggcgaatggtgcgtttgcagcgaaactcgataccgtattgcgcgcgctcgagcaatggcgccagggatttcagctcggcaaacacctgatggccactctcgaacagctcgtcggtgaaattgaccagcatgtcgcgtttctcgacgacttcatcttcggcgacctggctgatccagttgtgcggcagattggggccggtaagaaacagcgtttccgggtagaagttgcctatgtagtcgccgatgaacactttgcccgagctcgccacgatcagatgcaactcgtattccttatggaaatgccagcgcaccagcgggcatgggaagccgtgctggcggtagatgatggacaacccgttatggtcatccatcaactcgtaagaggggtcggttacgcgggctgttcggctcatgtcaggacgcttttattattatcgcctggcgatcatgcccctttcagcccgattgatacaacgtgcgtccgtaaactgctttcatgctgttggcgacccagcagttgcggacaatctcggattcatcgaaaaagtcggtgctgatgatgctgcaacgggtgacccagccgcggcttgagtgaaaccagtcattgagttgtttcttgatgtcgctcggcccgcctagtaacgagtagcaggtggctggcagtgaccagatgaatgtttcatggggcgtaccctccagagacttttcgatatgaaggccgagtgccgtcgtgtcggtaaaaactctcttgttccacttgtgcgggatctgcggccagaaatagtttctgtcctgctcgggtgagtagggcgctgccatgacgatgcggcgcttgctactgctgcgtttgagttcacctatcgtagtaattgagtccatatggggaatcagtcgtgaaccgaggcgattgagcataaagtcactcaggcgctgccgatcaaaagacttgttgccatcacccagttgatgaaagtccaggacaatgaattcgtcgggattccgatcgaggaaagccgcaaccgcctcgaccaactcatcgagcacgcggtgtgactgaaaaccgttgtggtgaaagtaatacagcgggcgctgcggcccggcagtgcacccgaggcgaatatcgaatgcgcgggcgccgttgtccagttgccaggcgaatgaatcgttctggcacgtcgtccagtgaccgagcacgacctcgtagttgggcgcttttttatccatgccgctgttgtgggtgccgggccagacgatatcggtcagcttgagctgatcgatatccagtacttggctcatccaggtctgcttgtcgagtgttgcggtggcgctgctcatcgtgacaactccttgtcgtcatacatcgccccatccttgggcgattgttgaaatatccgatgccgagggtgacatcgtccagtttcaccgattgtcgggaaagctcgaatacagcatacaaacaccgaagaacattaccagtcgcggaaatatccgctaaaaaatagccaatgaatggcactcgacagtatcagttacccgcgtcgcgctttactcagattcgtgctgatgcagaacgcaaccagtcgggtttcttcgaagaaatcgacgttgacgacattgcagttctggagccagtcactattggcggggtcaaaccagcgatccagttcggtatgaatgtcgaccgggccacccagcgccgcataactggtcgctgacagcgaccatggtgcgtatcgaaaaggcggagaggacattgttgtggcgatgaatttttgcaggtcgctggcactcggagtttgcgttccgatccattgatggtggagcttcgggttaaagtatttatggtcaagttcatgatgctgtggcgcatgaatcaggattcgctgcgtgcggcttatgcttttcagttgttgcagattcaggccgctattgctggcagggatgatcctgttacccagcagtttaatgagcatgtggttgaaccatgcaaagtcaaagggccggtcgccatctttcatttcatgaaagtcgaggacaatgaattcgtcgggatactctgagagaaagcgctctatgtcggttatcaggtgaacaagcgagcgtgaagacagaaagccgttatgctggaaacgaaatttgttaagttccatgccgctgttctggtaagtgagccgtaaatccagggctctggcgccattgagcagttggtcataaaaggacttgtgctggcaagccacccagtgtgcgcccgggatcagggcgtatgaggccttccagtcgcaaccggcgttgtgagtgccaggcaggctcaacttatagagcggtaaaacatcaatggcggtattggcactcatccagttagtgagtgcgtagttgctggttgttgcgctgttcatgatggcgtccctgtagtaaaaattaatcaagtaacttgctcgctgtctgggcaagtcacttgtttttaatttaattcgagggctttgatcaatgaattagttgatgctggatatatgtattgttaagtgtcttgctgtcagttgttatctgcttgatggcggtttttagcttcaatccattgcgccatgtattgagtgcttttgtgatggtggtggcgcaacatgctgccggtgaagtttgactttcttgactgcgccatgtttcgcaaacagtccttcaacttgtcgatgagtaacgggccatgtaccaacttccgataacgctcgttcaacatcgactgacctgccaggcgggctgcttcccagcgctgttcgtcgcggtaaagttgcacggcatggttggcgaaatcctctgcggtgcaggtgattgcgccgggccacggcatgccgccgtgcatggcttccgcaccgatcggtgtggtcacggacggtgttgcgcacagcatggcatcgacaatcttgcccttgatgccggcaccaaaccgcagtggcgccaggcacacccgcgcagctgacatgacttgcaaggcatcttcggcccagttcattacgtggaaaccttgcgccgcattgtgcagggccgtggccttgggcggggtgtaggcgccatagatgtgcaactgcgcttgcggcagttgcgcgcggatcaacggccagatcgtggttttcatccagagcaccgcatcccaattgggcgcgtgacggaaattgccgatgctgaggaagtgcgcgcgctcggcgaaagtgcgcggttcggctgtcggcaagtcgatcatcagtggacaccagtgcagcagcgcgaccggcaggccaaattcctcgaccagcaattggatctcgacttgcgaaatcatcaggttgaggtcgcaacgatacagcgcggcgatttcccgcttggccaggtcgctgtcggccatcaactcgaactcttcgcgcaacgccggtacgaacaacgaggtgaaatcctgattgtcgggatcttccctcaagcgctccttgaggcgctgctgccttgcgtgtcgcaggctttgcaggtcggaggtttccagcacgcgcagggcttgcgggcagtgtttctcgacccgccagccgaactgttcttccatcatgaattgatcgaacagcacgatgtctggcgctaattggctgaggaaagcatcgaagctgctgttgttgagttcgatcggtacttcacgaatgcccaaagcactcaggtcagccttgtgttcaccggggcctgccgggctgctgaaggtgatttcccagccttgctcaaggaacgtttcgagaatttgcatgacatgcccactggctgccgaagagcgtggttcgggccagacgtagccgatgaccaggactttggtggcgggggatgtgttcatgagcagatgttccttgaaaacgggcagggcaaaacgggcgcgcaattagaccacaagccgaagatcgatcagtcgatccggactcgctcaatgggtaatgacctggagcagttgctgccgcgaagcggatgttttggcaaagatcagtgaggcaaaatgccgttcaccttgtcgcgcagttgatcgatggaaaacggtttgccaatgacgtgcatgtccgcaggtacatcaatggtttcggcatagccgctggcgaacaggatgggcagggccgggtgcagcgttcgcgccttggtggccagttcacggccatccatgccgggcaggccgacatcggtcatcatcaggtggattttttctccctgattgcgcaaccattccaatgcctgctcgctaccatcagcctccagcaccttgaactccagctcctcaagcacatcgacgatgagcatgcgcacgatgtcgtcgtcttctacgacaaggatggtgaacggcggggtggacatattgaaggctctcaagaaattaacgctgggtttcggccggtcgaatgtgccgggctcttgcatgagtaagtagcgcatggccacaagttcccgaactgacacaaaaaagcttagctgcagttgaggcgggcaaggataactgttggcacataccgccgtgcaggggaaagtgggaaaatcctgctaaatctgtaggaaaaatggatccatgctgccattttggggcaaactccctgcttttcacccgatcgacaaggctgccccatgtcctcttcgtcctcagttgatgaacagcggtttcgtaaactcctgagtcgcaacatcagtctgcccctcggcgtaggcatactcagtgctgtgttctttgtgtcgctgattacctatttgctgtcggtgatccagtgggtcgagcacaccgaccgggtgatcaataacgccaatgaagcagtgaaactcacggtcgacctggaaaccggcatgcgcggctttttgctcagcggtgacgagcactttctcgatccgtacgagaccgccaagccgcgcattaccgtcgcactcaataccttgcttgagctgaccgccgacaaccccgtgcaaaccgatcgtctgcgccgtcttcaggccctgcagaccgagtgggcgaactatgcgcagtcgatgatcgacctgcagcgctccagcggggattacaaggccgccgtgaaggccgggcggggcaagcgcctgacggatgaaatccgcaaacagttcgaagatgtcatcgaaaccgagcaagtcctgcgtactacgcgtaacgaggaagtgcgccgcacgacgatctggagcatcagcctgtacctgctgttcattgccggtatcagtggcttgctcgcctatatcgggcggcgtgatctggtcaacctgtcgcaaagctacggcgcgacgctcgccgcacaggatgccagcgcctatcgcctggagcagcaggcgtggctgcgcaacggtcagacgcaactggccgaacaagtgctggggcaactgacgctgaatttgttggggcgcaacattctgcaattctgcgcgcagtacctcggtaccgctgtggcggcgttatacgtccgcgaagaacacggtggcctgaaacgtgtggccacttacgggttctcccgcgagcaggaagaacaggatcagtcgatttacagcggcgaaggtatcgttggtcaggtcgcgcagcaggcgcgtctgattcgcctcgattcggtcccggccgattacttcaaagtcagctccggcctcggcgaaggtctgccgcacagtgtgctggtcgttccaaccagcgatgacgaccgggtcaacggtgtgatcgaactgggtttcctgcgcccgctcaccgatcgcgatatcgagttgctggaactgattgccggtaatatcggtacgtcgatcgaagccgcccgttaccgccagcgtttgcaagaggtgcttgccgaaacccagcagctcaacgaagagttgcaggtgcagcaggaagagctgaaaaccgccaacgaagaactggaagaacagtcgcggattctcaaggagtcccaggcgcatctggaaacccagcaagtcgagctggaacagaccaacgaacaactcgcggagcaggcgcaaaccctggccgaacagcgcgatgccatggacctgaagaacaccgaactcaatcaggttcaggtgcaacttgaagagcgcgccgaagagttgcagcgttcgagcaagtacaaatccgaattcctcgccaatatgtcccacgaactgcgcacgccgctgaacagttcgttgattctggccaagctgctggcggaaaacccgcaagacaatctcagcgccgaacaggtcaagtttgccgagtcgatctactccgccggtaacgatctgctcaatctgatcaacgatattctggatatctccaaggtcgaggcaggcaagcttgaagtgatcgcggagaacaccagcgtcgcgcgtctggccgaaggtttgcgcggcgtgttcgaaccgatggcggcagacaagcgcctgaccttcagtgtcgatttgctgccgggaacaccggcaacactgttcactgaccgccagcgccttgagcaggtgatcaaaaacctgttgtccaacgctgtgaagttcactgagcaaggtactgtcagcctgaccatcagtggccaaccgaatgactgcgtggctttcgtcgtgcgcgactccgggattggtatcgccgccgatcaacaggaaagcatcttcgaagcgttccgtcaggccgatggcacgaccaatcgcaaatacggcggtaccggcctgggcctgtcgatttcgcgtgatctggcgacgctgctgggtggcacgatcagcgtcaccagcacaccggggcagggcagtgtgttcacgttgctgatgcctcagcagtacaacgagtccggcgaggtctcgactgcgccgttgacgtttactccgccgccacaggctgcggccgttgtacctgcggcgatggtttctccactggcgccggtgcacatcccgcgtttcgccgatgatcgcgacaaggcaccgttcgccacgcgttgcatcctcgtggtggaagatgagccgaactttgcgcacatcctctacgatctggcgcacgaactcggctatcaatgcctggtcgcccatggcgcagacgaagggtacgatctcgcccgtgaattcgttccggacgcgatcctgctcgacatgcgcctgccggaccattccggcctcaccgtgttgcaacggctcaaagagcatgccgaaacccgccacattccggtgcacgtcatttcggttgaagatcgggtcgaagcggccatgcacatgggggcaatcggttacgcggtcaaacctacgactcgcgaggagctcaaagacgtgttcgctcgtcttgaagccaaactgacccagaaggtcaaacgcgtgttgctggtggaagacgacgacttgcagcgcgaaagcatcgcgcgcctgatcggcgacgaagacatcgaaattaccgccgtcggcctcgcccaggaagctctggaaaaactgcgcacgacgatctacgactgcatgatcatcgacctcaagctgcctgacatgcttggtaatgatctgctcaagcgcatgtccaccgaggacatctgctcgttcccgccggtcatcgtttacaccggacgcaacctgacccgcgacgaagaggccgatctacgcaagtattcgcgctcgattatcatcaagggcgcgcgctcgccagagcgtttgctggatgaggtcacactctttttgcacaaagtcgaatcgcagttgtcccatgaacggcagaagatgctcaagaccgcgcgcagccgcgacaaggtcttcgagggtcgcaaagtgctgttggtggacgacgatgtgcgcaacattttcgccctcaccagcgcgctggagaccaaaggcgcagtcgtggtgatcggccggaacggtcgtgaggcgattgagagacttaacgaagtcgaggacatcgatctggtgttgatggacgtgatgatgccggaaatggatggcttcgaagccaccgttgaaatccgcaaggatccgcgctggcgcaagctgccaatcatcgcggtgacggccaaggccatgaaggatgatcaggagcgctgcctgcaagcgggcgccaacgattacctggccaagcccatcgatctggatcgcctgttctcgctgattcgcgtgtggttaccgaagatggaacgcatttagtggaacgcagtacgccagctgaacgaaacagtgaaatcgagctgcgcttgttgatcgaggcgatttacctcaagtacagctacgattttcgcgattattccggtgcttcgatcaagcgccgggtgcagcacgcactcggccagttcgaatgtgcgaccatttcggccctgcaggaaaaggttctgcacgatccgacagcgttcatgcagttgctgcaattgctgacgattccggtcagcgagatgtttcgcgacccgtcgcacttcctcgcgatccgcagggaagtggtgccgttgctgcgcacttatccgtcgatcaagatctggatcgccgggtgcagcacgggcgaggaggtctattcgatggcgattctgctgcgcgaagaaggcctgctcgatcgcacgatcatctatgccacggacatcaatccgcgctcgctggacaaggccaagcaggggatcttctcgatggagaatgttcgcgcgtacacggccaactatcagcaggccggtggtcagcgctcgtttgccgactactacacggcagcgtacggttacgcgattttcgacaagagcctgtgcgaaaacgtgaccttcgccgatcacagtctggcgacggacagcgtgttctccgaaacccaattgatttcctgccgcaacgtgctgatttacttcaacaagaagctacaggatcgcgcgttcgggctgttccatgaatcgctttgccatcgcggctttctggtgctgggcagcaaagagacgctggatttttccagctacgcaaaccagttcgaagcgctggtgaaacaagaacggatctaccgcaaaacatgaacgaggccgtggatttacctcgcgtcgaggcgattgtggtcggtgcttccgccggtggcgttgaggcgctgttgagtctgctcgtgccgctgcgccgaggctatgcattaccgatcatcgtggttctgcatctgcctgaagagcgccgcagccaattggccgaggtcttcgcccggcgcgtggagctgccggtgcacgaagctgccgacaagcaggacatcgttgccggcaatgtgtatttcgccacgccgggttatcacctctcggtggagcaggatcgcagcctttcgctgagtcttgaggaccgcgtgcattattcccggccttcgattgattacctgtttgaatcggccgccgacgcttacggtgcatcactggccgctgtcctcctgaccggcgccaatcacgatggcgcgcgcgggctggccgaggtcaagcgctgcggtggcttgaccatcgtccaggatcccgaagaggcgcaagtcgccaccatgcccctggctgcattgaaggttcagcagccggatcatgtcctacccattcacggcatcggccgtctgcttgtcgagctggaacgaatcgcatgctgagtaatatccaagccaaactgctgatcgtcgacgatctgccggagaacctgctggcactcgaagcgctgatcaagcgtgaagaccgtaccgtctacaaagccttgtcggcggatgaagcgctgtcgttgctgctgcagcacgagttcgccatggccatcctcgacgtgcagatgccgggcatgaacggcttcgaactcgccgagttgatgcgcggcaccgagaaaaccaagaacatcccgatcattttcgtcagcgccgccggtcgtgaactgaactacgcgttcaagggctacgaaagtggggcggtggactttctgcacaaaccgctggatatccatgcggtgaagagtaaggtcaacgttttcgtcgacctgtaccgccagagcaaggcgatgaagcagcaggtcgaagcgctggagcaggcccgccgcgagcaggaagcgttgttgcaacaactgcaaagcacccagttggaacttgagcaggcggtgcggatgcgcgatgacttcatgtcgatcgttgcccatgaagtgcgtacgccgctcaacggtctgattctcgaaacccagttgcgcaagatgcacctggctcgggacaacgcagcggcattcaccctcgacaagatgcacgccatggtcgaccgtgatgagcggcagatcaaaagcctgattcgcctgatcgaagacatgctcgatgtgtcgcgcattcgcactggcaaactgtcgatccggccgagtcgtttcgatctggtgcaattggtcagcaacctgctgcaaaacttcgcggcacagatcgaagctgcggaaaccgacgtgtcgttcaccgcgccagcaccggtggaaggccattgggacgagttccgcatcgagcaggtggtgtccaacctgctgaccaacgctctgcgctacggcggtcgcagcccgatccaggtacgggtttaccgcgaaggcgatgaggcgcgggtcgaggtgcaggactgtggcatcggcatcagccaagagaatcagaagcgtattttccaacagttcgaacgggtttccgccaagacggtagtggccgggctcgggctgggtctgttcatttccgagcagatcgtcgccgcccatggcggctccatcgtcgtcgagagtgaaatcaacgaaggcgccctgtttcgcgtttgtctgccgatccaggaaaacggcaaatccgacgcaacctctgagtgaccgcacggtcgtatcagcagctattgaccgaacaaaggcttcccatgagcgtagatgcgcaagatgtagtactcgtcgtcgaggacgaaccggttatcttgatggtcctgaccgattatttgtcagggcagggctatcgtgtgttgcaggcggacagcggcgagcaggctttcgaaatccttgcaagcaagccgcatctggatgtgttgatcaccgacttccgtttgcccggcggcatctctggcgtgcagatcgccgaaccggcggtcaagttgcgacctgacctcaaggtgattttcatcagcggttatccgcaggaaatccgcgagaccggcagcccgatcacgcgcaaggcgccgatcctcgaaaagcccttcgatctggatgtactgcaggaaaaaatccaggaactgctggcctgatatctgtgtaggagctgccgcaggctgcgatcttttgatgttgatcgttaaaaacaagatcaaaagatcgcagcctgcggcagctcctacagtttcagcattatcagcttttgatcatttcgcggaccttcgcggtcagcagatcgaaggtgaagggcttggtgatcatctgcattcccgggtcgagaaaaccgccgcgtactgccgcatgctcggcgtagccggtgatgaataacaccttcaggccaggccggtactgccgacctacttcggccagttgccggccgttcatgcccggcagaccaacgtcgctgatcagcaggtcgatccgttgcgccgagttgaggatcggcacagcgccgtcggcatcactggcttcgacaaacgcatagcccaactcactgagcacgccgctgaccagtacacgcacggccggatcgtcttcgacaatcaatacggtttcgccatccattgcatgaggagtctgcccgctgtcggtaaccggttgctcgtcttcttcgccgcgaaagcgcggcaagtagagtttgactgtggtgccttgatcgatttcgctgtcgatggacacatgcccgcgcgactgcttgctgaaaccgtagatcatcgacaggcccagcccggtgccctgaccaatcggtttggtggtgaaaaagggatcgaatgcgcggtttatcacactttgcggcataccgctgccgttgtcggtgacgctgagcatcacgtaatcgcccggttcaaggttgctgcaggcctcggtgaattcgctatccagcacctgattgctggtttccaccaccagttttccaccctcgggcatcgcgtcgcgggcgttgatcaccaggttgagcagggcgctttccagttgattgggatccgcttcggcgacccacaatttgtcgtgcaggcgcatgtccagatgaatgctttcgttgagactgcgctgcagcagttcccccatcgacagcaccagggtattcatttgcaccgctttggagtcgagtgactgccgacgggaaaacgccagtagtcgatgggtcaggctggcggcgcggttggctgaggtcacgccgaggtcgatcaggctgtcgagatcgtccgtacgcccgcgcgccaaacgccggcgcaacaactccaggctgccgataatcccggtgagcatgttgttgaagtcgtgtgcgatgccccccgtgagctggccgaccgcttccattttctgcgactgacgcaatgcttcttcgttatgccgcaattgcgcggtgcgttcttcgacttggtgttcaagggtttccagcgtcgattgcagacgtcgctcgctttcactcaaatcgatcagtcggtcgcgggcttcgtattgtcgtcgtcggccacgcagggcggcggacaccaagctgatcagtgtcgctggatgaaacgggcgttcaagaaaggtgacgttgccgagcagattgctcagtttcgaggaggggccttgctcttgtccgccgtgatgagtgagcagcacgatcggcagatccgaccacgccggctgcagctccagatgcaggaacagcgcttcgagttccggaccgcgcaaggcttcggcagcgatcaacagcaagcctgcgccgagttccagttcggtacagagcgtgcccagcccgggcgtgaccaggccgccataacctgcctcgttgaggatcatcagggcaatctgactgtcgcgacccacgggggccagaatcagcgcccgttcggccagcggcaccgacaccgtcacaaggtttcttcctgaagcagcgggttgcttgcgccgaggtaggtcggtacaccgcgcaacacaccctgaaaggcctcaagtggttcgccgatggtcatgccttgcgccgaaatgcggtattcacgaatcgtcgattcatggctgccggtgcgtttcttgatgatggaaatggcccggcgaaccttgcccagtgcttcgaaataacgcaacagaatcaccgtgtcggccagatatgtgatgtcgaccggtgcctgcatgtcgccgaccaggccatgctgggcgacggtcatgaatgtcgcagcacctttgcggttaaggtacagcagcaactcgtgcatgtgcagcaccaaggcgttttcttccggcatcgctgcctgataaccattgatactgtcgatgaccacggttttgatctggccctcatcgacgcaacgtcgcacccgatgggaaaactcgcctggcgacaactcggccgcatcgacctgatcgatcagcagattaccggtgtcttgcagggccttgagatcaatgccgatgttcttcatgcgctcgaacagcaagcccagttcttcatcgaaaataaacagtgcagctttttcgccgcgttgtacggcggcagcggcaaacaccatcgagataagtgatttaccggtaccggcgggaccgagaatcagtgtgcttgagccggtttcgatgccgccaccgagcagagcatccaattccttgatgccgctggtcaattgcaggcgtgggtagtcgccgcgatgttctgccgccaccaatcgcgggaacacatgcaagccgtcgcccatgatggtgaaatcatggaagccgccgcgatacttctggcctcggtacttcaccactcgcacgcgccgtcgctcggcgccgtagttgggcgtcagctcttcgaggcggatgaccccgtgagcgacgctgtgcacggtcttgtcgagtgattcggtggtgaggtcgtcaagcagcagaaccgtggcgttgtagcgcacgaaataatgcttgatcgccagaatctgtcggcgatagcgcaaagaactttgtgccagcaagcgaatctccgagaggctgtcgagcactacgcgggttggcttgacacgctcgacggcctcgaaaatctgcttggtcgcctcgcccaactccagatcggaagagtagagcaagctttgctggtgctcggcattgagcaggctttccggcggcgtcagctcgaagatcacgatattttcgtccagctcccagccatgcgatgcggcgccttggcgcaattcacgctcggtttccgacagcgtgatgtacagagtgcgttcgcccgcaacggagcccgccctcaggaagtgcaaagcggcagtggttttgcctgtaccgggttcaccctcaagcaaaaaaacatgcccgcgagacaatccaccggccaggatatcgtccagaccattgatgccggtggcagcttttgcactgataaactcgttggatgtagacaaaaaatgccctctcatgactacgggaatcgaggtcgctgacaaaaaatcgtgcggcctgaattacttgacccgctgccatgatggcagttccgcactttctttcggaatgtgccgagagaacagttgcttgtcggtcagagtccttgctgtaacgccgggtcatccgggttcagttgttcgagctgcgccagcagaacctgaacattttgcagctgtccgctttccttccagtaattgatcagtaatacccgcgccttgcggtcggccgggtggcgctggacgatttcctgcagttgcttctgcgccgcttccagctcctgcgcgctgtgcagggtggtggcgaggtcgtaacgatagtccttgttgtcgggctcgagttcgactgctttggacaagccgagcaaggcgtattcacgctggttatggtgcagcagccaaagccccagggcatgttgcagatacgccgagtcaggctgggccttgagttgttgcgcaagtaactgtcgggcggcatcgctctggccctgacggtcgagtacatcaatctgcatgaccagcgccggcaaattgccaggctcgacacgcaaggtattgtccagtgcttcctgcgcctgcttgagttcggcgttatgtatatggaggcgcgccagttgcagataagtggcggcgctcggcggctgttccttcaatgcttgctcccaaccatcgatggcctgttgcaacggcgcaaagtacaagccgagctcatccggtgacaagccgagcagggcgttgatcgcggcaaaacgcacgctttggtcctcatcatcgagcaatggcccgagcaacaggctgcgttgcccgcccggcaccagtccaatcagacttctgatcgctgccaaacgcacttcgggtgcttcattctgcaggtctgcatctgccagtttcaacgcttgcgggctcgggtaattgggcagttcggcatgcagccagaggcggcgtttgaccgacaggtccgggcgccccaattgctgatacagctgacgtgccgcgcccggctggccggcacgggcggccgccaatgcttcgctatagccatgtttgatcgcgtcgggcaccaccggtgcagtgctgcgcagggacaaccagccgacgaagatgaccagtgcgaggccaaggccgatgagcagatagcggcgggactgaggcatgcggggttccggaagcgtggatacttgagcagagcggcaagcttcggtcagctcgggctgcgagtcaaaccccgtgcatgcgaatcgccctacaagtcgcgtcgactcagttaaccgtcaggctctcgatgcagtgtctacgcttgcaggagtcgcttcgatgagtgtgcccatgcaagccctgctcaattatttcaatgctgtgatccatcccggtcgagccgtgttgctgtttgctctgcgcaccattgcggcagggctgctgactttgtatctggcgtttttgttcgacctcgaccagcccaagtggtcgatcatggccgtggtcatcgtcagccagcctttggcgggaatggccctggcacgcagttttggccaggtgatcggtaccacgctcggggccgccgtagcggtattgctcatggcgatctttccgcaggcaccattacccttcattactacgttggcgttatggctggcagtgtgtacggcgggtggcacgttgctgcgctacaccagttcccaggcgttcgttctcagcggttacaccgcagtggtggtagcgttgctggcgatcccggatcaggacggcacgtttctgctggctgttacccgggttaccgaaaccttgctcgccgtggcgtgtgtctgcttggtgagcctgctcacggcccggccggaagcggtcgccagcggctacttcgccaaggtcgatcaggtgatcaaactggtcgccagccacgcggctgcggtcatccgcaccgaagaaagcgaagccgatttccagcgccggcaaatgcaattgctcggtgaaatcagcgcattggagggattacgccggcatctgtatttcgacgcgccgcgtttgcgcagtgccaacaatctggtgctgctattaggtaatcaattgatgctgctgacctcaagattgacggcgctgcgtcatcaacggcaattgttgaccgagcgttgggaaggggatttgccactcgacgtccagcgcctgcgtgcagaggaactggcacttctcgaccagttggcgcagcagggccgcgcgttacctgccgaagcacgacaccagttcgtcacgttgcagcagcaattcgaacagcttgcctacaagtccgaacaattgactgaagagatgagcgcgaccctgagctccctggcgtgggctctgcgctgggaacaggcgcgtcttttgcggcaactggagcagatcctcgaattgagcgaggccatccaggagggacgcgaggccagttgcatgtatcgcggccaggccagcccgctgcatctggatttcaccctggcctcgatgaacgccgtccgtgcctttatagcgctgctggtggccgggctgatctggatcgaaaccgcatgggacggcgctcggggcgggatgattctggtggggatcctgtgctcgctgatggcaacgtttccgcgaccgctgatggccgcacagagttatgcacgcgggctggggctggcgcttttggtgtcggcgctctaccagttcgcgctggtcccggcagtcagtgatttcgaacctctggccttgttactggcgccattgttgtatgtcatcgcagtgggactcgcgagccctgcaacagcggggatcggcatggggctggggctctcgagtttcctgatgatcggcccgcagaacatcggtaccgggcagaacactgcgattcaatggtttgaatttgccggtgcctatgtcagtgcggcaatgcttgccttgatcgtttacgcgtggattttcccgtttcgcccggtgctgcgcattcgccgcttgtacaacgaggcgcgggagcaggtgtatcagttgagcaaggcgccggccaccgacgaacaacagtttgccttcgagagccggatgaccgatcgactgacgagcatgcttgggctgctgcctgctgcaaatgaccgggcgatgcagcagttgtatgaaatcagtctggcctgtgtcgcactgggggtggccacgcaccaactgcggcaacaggcacagaacaatactttgctcacgcaaaccttcagtcagcaattgtcttcggcattgcgccagaccgcgcggtttgtcgccggacgtgcggacgcgcaactgacgccgttgctgggcacgctgcacacccttggtgagcaactggacgcgttgcacgtcgccagtcacgcgcatttatggtcggtgtttcgcatgcgcgtggcattgctgatcgtcgaggcttttctgcagcgtcatggtgaacatttgcaacgaaacatcgaggaaggagcgccagccattgcccattgatttcgaaattggcggcgtttacttgccgcccattgctcaggcgctgttgctggccatgccgattttcatgctgctcgactggctcttgcggcgcatgggcgtactgcggcgggtctggcatgaagccctgttcgaaggcgccttgtatgcctgcgtttgtgccacgctgattctgttgatgggagcctgacatcttgaaattgttactcgcgcggttgacgacagtggcagtggtgattctggccatcgtgctcggctggtttgcctgggagcattacacccgcgcaccatggacccgggatgcgcgggtgagggcggacgtggtgacgttgtcggcagacgtctcggggcgcattgtcagattggcggtgcaggacaaccagcacgtcgacaaaggccagttgttgatggagatcgatcctgcgcgctacaccctggcagtggagcatgcgcagcgttcggtggaagtggcaaaggctacattggggcagtcgcaagcagcgatcatctccagtgaagccttgctcaaacagcgccagagtgaagagcgccggcggcgtacgctgaagcagggtttcgccatctcgggcgaagaatgggagaaatccagcactgacgtggccgtggcccaggccgatctgttgcgcaaccaggccaatctcggcctggctgaggccaatgtgcagttggctattgctgcgcagactcaggccgaactcgatttgcagcgcacccgcgtcgagtctccggtcagcggctacatcaccaatctgttgacccgagagggcgattacgcggtagcgggcggcgcgctgttggcgctggtcgacagcgaatcgttctatgtcagtgggtatttcgaagaaaccaagttgccgcggatcgaagagggtgatcgggtacgaatccagttgatgagcggtgaagcgtttgctggcacggtgcaaagcattgccttcgccattgccgaccgggaaaacgcgccgggcagccgattgttggccaacatcaaccctagctatacctgggtgaaactggcgcaacgggtgccggtgcggatcgcgatcgacgccgactatgccggcaagaatcgcctgcgcgccggcaccaccgccacggttaccgtcgaacacccctgacaatgctgcgccctgacaccccctcctgcggcagctcctacagggagaaggttcgagtattaggcaggcacaaaaaagccccgcgaccgaatgatacgcggggcaaagaatctggttggttgcggccaaccaaaggagctctttaacaatcgattacttgctggcgacggtctccggctgccagccgccacctagagccttgtagatcgcgacgatgccgcgatacagatcgacttcagcctgggcttgagtgtcttcagcgttcagacgttcacgctgggcatcgagcaggacgaggaagtccgtggtgccttcgcgatagcgaatttccgccagatcagccgccttgcggctcgattcactctgacgaatcagcgagatcaggcgttgctgacgtttgccgtaatcactgaaagcgttttccgactcctcgagggccagcagcacttgttgctcgtaggtcgccagcgcgccttcggcttcagcatcggcgccgcgcaaacgggcgcgcacgctgccaaggtcgaacgccgcccacgtgatgctcggaccgagtgcccaggcgttggccgccgaggaaccgatctgtgaaccacgcccggccgtccagccgaggaagccactaaggctgacccgaggaaagaggtcggctttcgccacgccgatgcgcgccgtggccgaagccaggttgcgttccgcgctgagaatgtccgggcgacgttgcagcagttcacccgggtcaccgatcggcaaggccttggctatcgctggcaagtcttttggactcaggtcgacggtcagcttgtccgggcgctcgcccagcagggtagcgatgcggttcttctgccgaacctgctccgcctgcaattgcggcacgctggcttcgaccgaagccaggcgtgcatcggcacgctcgacatcgagttgatcgccaacaccggcgtcacgcaggctgatggtgatcttgcgcgactcctgctggttgttcaggttggccacggcgatcttttcccgcaattgcgcaccacgcagttggccgtaagcgtccaccagttcggcaatcatggtgacttgcaattgatacagatcggcttcagcggcttgctggtcggcgtcgctggcttccagattacgctggatgcgcccgaacaggtcgagttcccaggccatgtccagaccgaggtcatagcgttcactattgacccggttggtggtctggccagggatttgccccttggccaagtcactgctggcgcggctggtgatggttggcattgcgtcattgctggcgtcgtcgcggatcgcccgggcggctttccagcgggcgaatgccacgcgcagttcacggttgccttgcagcgattgcgtcaccaactggttgagggtcggatcgtcgaattgctgccaccagatgccttcgaatttcgaacggtcgaagttcttttgcccggcggcgccatcggtagcggccgtgatattggccgcctccgtggttggggtcttgtagtcggggccgacggcgcaggcactgagggccagcaccagcaggctcggcaggaagactttcagactcattgttgcgcctccagtggcttttgaagattgagcgccttggctgctttgcgctgctcaccgcgttcgacgaaattacggatcagtacgtagaacacgggcgtcaacaacaggccgaagaaggtcaccccgagcatcccggagaacaccgccacacccatggcgtgacgcatctcggcaccggcaccgctggagaacaccagtggcaccacacccatgatgaacgcgaaggaggtcatcaggatcggccgcagacgcagacggcatgcttccagtactgcagcgagcgggccgagaccttcttcctgtttgtccttggcaaactcgacgatcagaatcgcgttcttacaggcaagtcccaccagtacgatcaaaccgatctgggtgaagatattgttgtcaccgcccgagatgatcacgccggtaatggccgagagcagggtcatcggtacgatcaggatcaccgccagtggcaggctccagctttcgtattgagccgcgagtaccaggaacgccagcagtacgcagagcgggaacacgaacagcgcagtgttgccggacagaatctgctggtaggtcaggtcggtccattcataggtcatgccgttcggaagttcttccttgagcagtttttcgatggctttttcggcctggccagagctgtagcccggggctgcggcaccgttgatttcagcggtgatgaagccgttgtagtgcatcacgcgatcagggcccgaggtgtcgctgaccttgataaaggtcgccaacgggatcatttcgcctttgttgttacggactttcagctgaccgatctgatcggattcgaggcggaactgctgctcggcctgaacgttgacctgataggtgcggccaaaacggttgaagtcgttggcatacagcgaacccaggtagatctgcagggtgtcgaagatgtcgctgacggccacgccgtgtgtcttggctttttcacggtcgatcgcggcatcgacctgcggcacgttcacggtataactggtgaacaggccagccagttccggcacgctgtggctcttgttgatgatgttcatggtttctttgtacagctcgtcgtagcccaggttgccccggtcttcgatttgcagacggaaaccaccaatggtgcccagaccttgtaccggcggtggcgggaaaatcgccatgtacgcttcttgaatgttggcgaactggccgttcaaggccccggcgattgcaccggcggacatgctcgggtctttacgctcgtcgaacggtttcagggtcacgaacacgatgccggcgttcgggctgttggtgaaaccgttgatcgacagccccgggaacgctacggcgctttccacgcctggctgtttcagcgccagatcagacatgcgcttgatcacatcttcggtgcgatccaggctcgaagcgtccggcaattgcgcgaaggccaccaggtattgcttgtcctggcccggcacgaaaccggtcggggtgctggagaaaccgaagaaggtcagcaccatcaggcctgcgtacaggaggagggcgatgccgctgctgcggataacccgccccacagtgccgacgtagccatggctggcacggtcaaagaagcggttgaacggacggaacaaccagccaccgaagatcttgtcgagtgctttggaaaagcggtctttcggcgcgtcgtggcttttcagcaagactgcggccaacgctggcgacaaggtcagcgagttgaatgccgagatcaccgtcgagatcgcgatggtcagtgcgaactgcttgtaaaactgcccggtgagaccggagatgaatgccgccggaatgaacaccgcacacagcaccagtgccgtggcaacgatcggaccggtcacttcacgcatggcgcgcttggtggcttccaccgggttcaatccgagttcgatgttccgttcgacgttctccaccaccacgatggcgtcgtcgaccacgataccgatggccagtaccaggccgaacaaggacagcgcgttaagcgagaagccaaacaaatgcatcaccgcaaacgtaccgatcaacgataccggcaccgccaccaacggaatgatcgaggcgcgccaggtttgcaggaacaggatcactaccagtaccacgaggatcagtgcttcaaagagggtgtgaaccaccgcctcaatcgaaccgcgcacgaagatcgtcgggtcatagacgatgctgtaatccatgccttgcgggaagcctttcttcaactcgtccattttcgcccgaacgtcgttcgagatgtcgatggcattggagcctggacgctgaaagatcgggatggctacggccggctgattatccagcaacgaacgcagcgcgtattggctggaacccagttcgacgcgagcgatgtctttgaggcgagtgatttcaccgtcgtcgcctgcacgaatgatgatgttctcgaactcttcctctgagaccagacggccctgagtgttgaccgacagctggaagctctgggcattcggggctggaggcgcgcccaattgaccggctgcaacctgacggttctgctcacgaatcgcggtgaccacatcggtcgcggtcaggttacgcgaagcagttttgttcgggtcgagccagacacgcagcgaatagtcgcccataccgaacagttgcacgtcaccgacgccgttcagacgcgccagctcatccttgatgttgaggatcgcgtagttcgacaggtagagcatgtcgtagcgtttgtccggcgaggtcaagtgcacaaccatggtcaggtcgggcgacgccttgtcgacggtgataccgatgcgcgtcacttcttcgggaagtttcggctcggtacgggtcacccggttttgcacctgcacctgcgcgttgtccaggtctgtgcccagggcgaaggtgatggtcagggtgatcttgccgtcggcggtcgactgcgaggacatgtacagcatgttctcgacgccggtaatcgcttgctccagcggagcggccacggtttcaccgatgactttagggttggcacccgggaagttcgcacgtaccaccacggtcggtggcacgacttcgggatattcactgatcggcaactggaacagcgagatcgcaccagcgatcaggatcagcagcgacagcaccgctgcgaagatcggccgtgaaatgaagaattgggaaaaattcatcggagttgtcgtcccttaaccgcgtggggtcgtggcggccagcttcacaaccgcaccggacgcacccttggcaggggcgactttgggcaggttgctggcttccagcgcttgacgttgttgagcgagtgccgcgatggtctgttcgctggccatcggtaccacttcaggggtgaccggcgagccagggcgaacccgttgcagacccttgacgatgatcgtgtcgtccttgttcagaccggtacggacgatgcgcagaccttcgattttcggacccagttcgacggcgcgatacgcggttttgttgtccgcatccatcaccagcacgaactttttgccgaggtcggtaccgaccgcttcgtcgttgatcagcatcgcgttgtaagtgccgctgccaaccagtttcagtcgtgcgtacaggcccggggtgtaggtgccgtcgctgttgtcgaacaccgcgcgaccacggatggtgccggttttcgggttgacctggttgtcgacgaagttcatctgacccaggtgcggattgccgtcctcgttggacaggcccatgtacaccggagtcgtggcgccacgctgaccgttacgggccagttgggtgtatttgaggaagacgcgctcgtcagcgtcgaagtaggcgtaaacgcgatcggtggaaaccacgctggtcagcggcgtagtgtctgcggtcaccaggttaccggcggtaatttcggcgcggctgacacggccactgatcggtgcggtcacgcgggtgaagctgaggttcagtttggccagatccagctgcgcctgcagggcaccgacagcagctcgggcttcttgagccgcactggtacgcgagtcggcgagctctgcagaaatcgcgttgctggcacgcaggcgttcgccacgaccagcttcgttttcactgcgggtggcgttggcgcgggattgggctacgagggcttcgaggcggcgcacctcagcctggaacggacgcgggtcgatctggaacagcaggtcgcctttcttgaccagcgcgccttcagtgaaagcgacttgatcgatctggccggagacccgtggacggatttcaacggtttccggcgcctcaaggcgcccggtgaattcgtcccactcgttgaccggttgctcgattaccttggccacgctgactttggcagcaggcgcggtggcggcagtctccggagtcttgccgcaggcgctcatcaccagtacggccaacaaggccaacgggaagcgcaaatgtttgagtgactgttccatggatgcatccgccaatgtattgaagatgggcggatgatgatcggcggggtgtgatggcacgaatcgaatgaagcaaaggtaactatcattcggaatgatataagacccgaacgagccctctagtatgcgtctttcgttagggggctatcaatatccgtgatgaaagtttcatgatgcgttgcgtagcaaatcacggtgcaaatccgcaggccagaaacaaagagacggccatgaaggccgtctcgatcagctagatgccgatgtgtatcagttgatgcctttgcggttcggaccgaaacggttcgggcccggctggctgtcttgcgccaggaacaccaggttgacgattggcagcagcaaccaccagccgctacgatcggtgtcgtgcatacgacgtacaccaacggcaatgctcggcactagcagcgccagattataaagaccttgcagaaccccgccggttttgaaaaaaccgtcaatgaatcccataacgaacgcaacacccatgctgatcaggaagaacaaccagtattcacggcgcgtagcacgaccgttgaataccgcgtaattcttcaatgcttcaaggtaaggattgcccgtcgaaatggcggggccttgtgcataggactgttgggttgcctgaggcgccccgcactgtgggcaagccacggccaaagtgcttatttccttggcgcaaccgcggcagaaaaccatgctcatattttttccctaaaattattcaatcgatagacacagcaaaaccaacgcggtaaggccagacaaaatgatgccggcgatcgcaaggtttcttcctgagtgtttttggttgatgcaaatgatgccgcaggcgagaccggtgatgctgataaaaccaacaccgaggatcgtttcagcgtcccattcggaatcatcaaaaagcgtgagtgcgcagataattccgaggatcatcgaaacgatggctagccagggtacttcggcttgcgtttgcggcacgaaggcctgttggctggccccgcattgggggcaagagagcgccgtttcgtgaagctccttggcgcaagcacgacaatagaccattgccatcgttttccttaactgagtgcgaaatcccgaccttccgtaggccgaggcggcgctaagttaatctttattaccaaatttgtcatcaggcactgtgccactaatggcatttttgcccttgtagaagctgtggtgggtggttcaacactcctttgagagcctcaagacctataagtcccgagcaagcgcctgacatgcacatttcgctagggggctataaatctgtttggtgacaaatctgtgtagcgatgcgtgcaaaggtcatgaccgcagatgaaatgattgcatttgaatagtggctctatgatgttatttttcgcgacccatttcctgtttcattcgctcaaggagaaagagcactcatggttgagcatcagttgatcctgttcggaccgcccggcaccagtaaaagccatcgggcccggacgacaaaggccgaggctctgggcgtggacgatgcgcagatcgttccagtcgcctttcatccggattacagctacggcgaattcgttgcgcgattgatgcccagaactcgggaaaatcagatcgagtatcgcgtccacgccgggcctttcctgcgtgcgttggcgcttgcctatagtcatctgcctcaggcaagtaacggtcaggcatcgcagaacgtattgctgcttgtcgatgagatcaaccgcggtaattgcgcagaaatttttggcgatgtgttccagttgcttgatcgtgatgatgagggctggtcgagctatgcgatcagtgtttccgatctggtgatcgatgcgcttgaggccgagcttgcactgctcggccacaacagtccttttcccgatttgaacaagcgactggcggatacgctgaagcagcgtcagttatgcttgccgccgaacctgatcatgatcggcacgatgaacaccagcgacgaatccgtgtatttcatggactcggcgttcaagcgtcgctggcattttgaattctgtgctgaagagttcagcaatgacgtgccggccagccagaaaaaggctctcatgccgtcagcacatcatttgacttgggagacattcgtcaccgcgctgaaccagttcattcgagaccgctgcacagccccaaggctcgatgacaagctggtggggccttggtttatcaaaggcaggcgcgagccggatagaactctggccgatgtctacccaaaagaactgaacaagctcattgccgcgaccggcatgattggcgaccccgccagcggtgttcggcaaagcagagcgttcgacgatgacttgaagacgctggctgacaaaatgtccgaagccaatcgcaagcgcttgctgaaggagggtggccatgatccaaaagctgaactcaagttcacaagaatccgttccagttccggccatgcaaatcagtactactgttcaaagacctctccaaagaagttcaagtcggacaccaaaggtctgattatcgaagactatttagagcagcttgccaggttcaaactgcactctgaagttcaccgcattgagcgcgccgatatcgtgggcaagttgttcctctatttgtgggacaacgtctttgatcgtgaccggtccccgttgtgtacgctgctcgcaatcgaacagcgtgagctgcgcaccttcgggcagtttgccatgcgggtcgacgagttcattaaatgcttgtgcccaccccctgatatccacgaactactaagcgccgcgttcgttgaggctgccctggatctggaagatgatgcattgcctgcatccgacgaggcctgacgatgctgctcgacgacattgaacgagtcgaaagcgacggcgaggtgggactgtttcgcgaaaaggatgggcgctatctgttgaaggtgccccatggcatgagcgaagtgaacagcgctgaggcgttgtcgctgctttaccgttgtttcgtagtgtttcgccgaacccagcgcgagcatgaggtgctgacagcccatgatggtgtcgaagccgatgacaagggcaatgagcgggctgacgacggaatggcgttccacgacgcgctggcgctggacgagttgttcgatcgtgccgacccacgcagcctgctttcaatgtgtgagcggcgcggtcgcagtgtcgataacccatatcgccgttttgatcgacatctgcatcgtgcgctgtttgatcaacgaggcgcggcttactttgagtcgatccagcaagaccggcggttcggtcagtttggcaaggcggatatcgtcggcctttactgctttctggcgctggatttttatcggggttttctcaaagtcgatccccgatgtgcctggggcagtttcgttgttgaaggcgaagcgctggcgcaagatttccgccaccgttacctcagcgccgaagactcgctctattgcggtgatgcgctgtcacgccagcgcagcctgagccatctgcgccacttgctgcaaagtatcgaccgctgcgcggcacctcgcgacgctcactattatcagttgcacgatgcgctggagcgatacctgcatgcgggtacacaaagcaaccaggacaccgggctgatatggggcgttggaaaattctgggcagtctgggagtcagtctgtttgtgtcatgggttgaacgaaggtgaaggcaggctcgaagctttccagacttgcgatgatcagcatctgccacttggaatagccgatgccacgacgctagcccgctggcaaaagcagcgctacaggattttcgctcgcaaccacatcaaacggcgccccgatctggtcaagcaggagggtgaagtctggacggtggtggatttcaaatactacgagcaggctactttaaaacggccaaagtggagcaagaatgctgagctcgccaaggaagagcgggactttctgaatctggaggcctacgggctgctactgcataaccatctggccagagaggggttgagcgagcacgaagtctggctggagatgtggttgccgggcgagcgagagtcatggttcgagtttcgcggcgaaccggcctgggacccgccgctgcgtgtgcgtacgctggcgaccaccgagctgatcaaggcatacgctgatcaataccagtgctcgacacggtcctgatcccatcaccgccgggcgccagctacttcttcggcatggtggagcgctttaccgggcccttgctgctcaaggtacgccgcgcggcatggaccgcacgctcggaaagtgcttccatgcgtggcgattgcagttcccaggcatgccaataaagctcgatatcggtgaaatgccccggggccacatccaccagatcccgacttttcagcgaatcgctgacctgcatatacggcaccattccataacccagccctcggcggatagctttcaggcgtgcctctggaagtgacaattagtgagtgggataagcgtctgcgtgcaggccgaagcgtgactgcacgaaatcagactgcaatgtgtccttgcgagaataggcaaatactggtgccttgcgcgcagcagagcgattcaggcccttggcaaaccagcgttgttgaaagtctggtgatgccaccagttgataacgcatcgagcccagcaactctgcaaagtatctcacgcatcggctctgaacgcgtgccgatacagccgattacttggccactttccagcagtgcgtaggtgtgatcctgatctgtcgtactggattcgaagagacagatgggtgacaaactgcacaactttagagaaggcgggttatatcgacaggtttgtccaagggttttccagtgaaacaccttggcggttgttgatactgcaagaaagtgccagtaagcaggccgtcggaggtgatcttgtatacggtgtggagagagttgtcgggatgaagccctacgtggatagttacattgacctactgagtggcagtgacaaaagggcagcactagatacggatcatgtcatacgccgtcgtatgcaagagaagtacctggtatcgagaagtcaggatatttgctccttgtatcaatttctgctggaaggtgagacaccaaagtgactctgtaggcctataccttctgacggacgctaaaacgttgaaggggagcctgcgatgatcaaacaggatagctacgcgcatcaagcgacagctacccgggaccgaaccacaggatctcgacccttgtttcaaagactatccggatccccaaaaaacatctgaatccgcgaccgcaaccatctctcccccggatcattatcctgcgacccacgccacgccatgtgcagctcaaacgtacgcgtcggcaacggcggatcctccgcgcgaacaccgccagccgctgtcagcgcatccgccgtgtaatccggcacggtcgcaacgatatcggtgcctgccaaaagcgtacttaacccgttgaactgcggcacggccagcaccacatgccgtttgcgacccagtttctccagctcttcatcaataaacccactgagatcgccggcaaacgagaccagcgcatgcggccgcgcgcaatagtcatccaggctcaggggccccggcacggtatcggcgcgcagcagtttaggcgcgctgcgacgcaggaccttgcgcttggcgttggccggcaggtcggtggtgtagctgacaccaatggatatctcgccggaggccagcaggcccggcatcaatatgtagttgacgcgtcggataaccaacacgattcccggcgattcagcacgcagacgtttgagcagcatcggcagcagggcgaattcgacgtcatcggacaaaccgatccgaaataccgatgtgctggtcgccgggtcgaattcggccgcgcggctgacggcggtcgaaatcgaatcgagggccggcgagagcagggcgaagatttccaccgcgcgggcagacggttccatgctgcgcccggtgcgtacaaatagcgggtcatcgaacaggctacgcaggcgcgagagcgccgcactgatcgcaggttgaccgagaaacagcttttccgccgcccgggtcacgctgcgttcgtgcatcaatgtttcgaatacgatcaacaggttcaggtcgacacgacgcaggtcattacgattcatctggagtcctggcagagtcatcaagcttgacgagagcggccatatgagaacaatggccagcatgaatattacggtgaaaggctggtactctgcaccggaaaattcagctttactgagacggtggcagcagtttttcatgggttttgccaatgccgcccatactgcggaatcaatgacaggcatgtcgactattaatagccactgatagtcttgggtcgaaagcccagatagagttcatggcattagaggttactttgacgaggtttgcgatgtcccgcacgatccgttttcacaagtttggtcccgccgaggtgctcaaatgcgaagagcatgcggccgctcagccaggtcctggcgaagtgcaggtgcgtgtcgaagcgatcggcatcagctggtatgacacgctctggcgtcagaacctggcctcgtctcaggctcgcctgccttcgggccttggccatgagatggccggtgtcgtcaccgcagtcggtgccaatgtcgaggacttgtccgtaggtgacaaggtcgccagttttccggctgaaagcccgaacgactaccctgtctacggcgagcagatcgtattgccacgcactgcgctgacccgctatccggacgtgctcagcccgatcgaagccagcgtgcattacacgccgctgctgattgcctactttgcctacgccgatctcgcacgggtcaagccggggcagtttgctctggtcactgacgccagccattgcgccggtccgtcctttgtccagttgggcaaggccatgggtgtacgggtgattgccgcgacgaagtcagcgcaagaacgtgaatatttgctgtccctgggcgccgagaaggtcatcgtcaccgaggaagaagatctgctgatgcgcgtcaacaagatcactgacaaccgtggcgttgacgtagtgttcgacggtctgggtggcccgcagatgtcgctgctcggcgacgtcctggcaccgcgcggcagtcttgtcctgtatggcctgcaaggtggtaaccagacgccattcccggcgtgtgcagcgttccagaagaacattcagttcttcgtccactgcatcggcaacttcaccggcaagccggaactgggcatcactcaggatcatgtcgcgctgcaacgtgccctgcgtgacatcaaccagctgacagccgatcgagtgctggagccgttgaagacccgggtgttcccgttcaacgagttcgtcgaagctcatcgctacatggacgaatgcccatgccgcgagcgggtcgcactgcaaatcgaacctgcctgaccctgctgaacagagtccgtgaccccacggactcttctgtgtttatccctccccaaatgaaagcctgcctggtttcgcctgtgcggccgttcagcaactgaactggtttttgctttcgatctgtatcttctaatcgtcatataagccctgataattgaatgattactttcatctcaaggaatgagccatgtctgtgcattctatttgtcctgtgcaatatcaaacagctacttctgtgcgcttcgataatttctgtttaattgttgtagggcgtttccgaggcagcgtctttttttcttgtactcaattgtcgtgggacgttgtcggaagtttcctagggtgctttttatgcaaaaaatatccttctataacaatgtgttaatggcgctggttgtgcactgatcagtctttgattgctcatgtgtttcaaataactacgatcgcgtaagtgttagcattcaagcgtctattacttattgatgaattgttgtgcgactgacctttcagtgcgcgcggcatgaaactattgataccgggtaaataccgatgactacgatccatgatcaggcaatgaattacgtctaccagcaagttctgcaacggttattgagcttcttctcccgtgcagagcggacggctttgcagctgttgatccagcgcctgctggtggcggccggcggcatggaacacatcggatccttcaaggtgctggtgatccagtcaggctcacgggacagttgctacacgttggcattgctgcgagccgcgcaactgagccttgcaggtcgggcgccggcgacctttcaattgcgcgttgcctctttgcgcttgaatggcaacagccatggcgcactgcagaacatgcatcgcagctacggcgcgctgtttctctacgacgatcctcgggtcgagttattgatggtggatcagcgacaggttgctcccttcgatttccagtcggtggtcagtgaagccagtcgcgaggctaatcgcgtcaatctgctgatgtcggggcatcgccgaacctcgaacgaaatcctcgaattatgggatgacgcctacctggctacagcggagttctacagccagatcgctcgctggaacaacggtgtcgacgcgatgatcggcgctgagcctcctcgtcggcagacactgtttctggaaggactcaatcgggcggcactcaaagccgggattggcggattaccggcgaatcatcgcggtttcgaggcgttatttccgatgcttgacgggctgggtagcgactactaccggcatttttacacggagggcgagcaattgccgtggcgtccggaagggcagttcgaggcgtgtcgtcgctccagcttcatcgacatcaacgacatgattgtcggcaaactcgaagagcgctggcctttgctcagtgacttcctcggatttcaggccgacgacctgacgctgcatcaaggtgatcacgagttcgttgagccattggtggccgcgcacctgcatggattgcacgcgagtgtcatcgaagaccagacctatgagagcggtgttgccgtctatctgcaagacactctcgcaacattgcgccgcaatcaggtgcccgagccggtttgtgaacatttgctggcaacctacggcaacctgctcgatcttgaacagcggcgaatacatgctgccagtcacttgcaggaaaccttcaatctcagtgaaaaccagctgacgtgtctgctgtttgcgccctttatcaacagtggcgcggggctcgaaatatttctgcgcaaatgtcatccgggcatgctcgtggcattgccggatttacatcgtgccatgcaaggcttgcatgccccggaacaagtgatgaagtggatgaccgaggtcagtgggctaccggtgaaattgattgcccgtttgtacgccatgggcgcaatccagattcctgagtcgccagagcagcagaactcgcagaaaccggcgacagctgtcacgcaaacggccgcaaatgagcggtcggcggaaggttgaacgtgatttctgcgagagtcgcagtgcaatggctcgcggatccgcagccatgaaataccggcgggaaaatgatttcgcgtatcaggcggtttatcgatatctgaccgtgttgatcaacgcctccgtcagtggctgtgcgctgcgtttaccttcattaaggcagttggcggagcgtttgaatgtctcgatctcgaccattcagtacgcctattcgttgctggagaaagaagggcgggtctattcggttgctaagtccggctattacgcccaggcgtccgcgctgatggcaccagctgccaacggtagcgacgtgcttgaagcggtgtatggcaatgcgcgcctcccaggaatgtgcgtactgagtgcagatgagccggcttcattgcagtctctggacagtccgttgttgatgctcgaacgcgagttgctgcgccagtaccctcgccagccacaatcattggcgcagccctgtggtgaactggagctgcgcacggttctggccgcgcgatataccgtttccccggttaactgctggcacgcggatgacgtgtacataggcgccgacctgcgttcggtactggaaattctgatctgcgtactgcagttgcgagacgtgacggtgctagtggagtcaccctgcgactgggtgatcctgcgactgttggaagccgcgcaggtgagggtgatcgaattgccgttgcaggctgacggtcagcttgatccgcagcaactggtgatgctgcttcagtccgaacgagtcgggttgatcctgctgtcttcgtcattgagtttgccgcacggcagtctcgggccggacgccaatcggcaattgattgcccaactgctcgccaaccatggcacgtgggtgctggagaacgactgcagcagcgaattggccgacgagccatacgcccagcgtctgcgcgactggctggatcctgatcggttgctggtgtttagcgctttcgacaaacttatcggtgtcgaagcgccctacggttttgtcttgtcacggcagtggcgcaccgagttgcaacggcatttcctgctgcgctcgtttcgattgtcggcgactcgccagaaagccctcgcacgattgtttgcgagtggccgcatcgaccagcatttgcaggtgctgcgacgtttgctcaaggagcgtcgaacgcaattgatccacttgctgcgtgagcgtctgggcgatgcgctgcagattgtcgaaccgcaaggtggcgcaaccctatggctacgttcgatacgtcgggtcgacatgaacgaagtgttccagcgcctgctcagacagcagatcgttatcgcccccggtgaactgttcagcctcaacggccattatccacatcacctgcgcttgagcccgatcagtcacagtgatcacgatctgccagatgtggtagggcgggtcgccgatgcactgcgactggcctcggcgactgacgttaaaaaacatctgagttgatccggatacatcccatcgcactgcggtcaaactgccagtaaactgcgctgtatttcctgaaccactcgatctcagaggttttgcatgacactcagtccttttgcgggcaaaccggcaccggcagaattgttggtcgatatcccgcgactggtaacggcctactacacgggccaacctgatgcatcggtttccactcagcgagtggcgttcggtacttccggacaccgcggcagttccttcgatttgagttttaatgaatggcacgttctggcgatcagccaggccatctgcctgtaccgcgaagcccagggcattaccggcccgttgttcgtcggcatcgatacccacgccttgtcgaccccggccggcgccagtgcgctggaagttctggcagccaacggtgtgaccgtgatgatcgccgagggtgacgaatacaccccgacgcccgctatctcgcacgcaattctttgctacaaccgtggccgtacctcgggcctggctgacggcatcgtcattacgccgtcgcacaacccgccgcaaagcggtggctacaaatacaacccaaccaacggtggtccggccgatactcacatcaccaagtggatcgaagccaaggccaacgaactgctggccaacaagctggccggggtcaagcgcatcagctacgagcaggcgctcaaggccagcacgacccatcgccacgattacctgaatacctacgttgccgacctgatcaacgtcatcgatttcgatgccatccgtgacgccaaattgcgtctgggcgttgatccgctgggcggagcaggggtgcgctactggtcggccattgccgagcactatcgtcttgacctggacgtggtcaacaaggaagtcgattcgactttccgtttcatgaccgtcgactgggacggccagattcgcatggacccatcgtccagccacgccatgcagggcttgatcggcttgaaagagcgtttcgacgtggcgttcgcctgcgacccggatcacgaccgccacggtatcgtcacgccgtccggtggtttgctggcgccgaacaactatctggccgtgtcgattgattacctgttccagaatcgcccgcaatggcgtgccgacgctgccgtcggtaaaaccgtggtcagcagcggtctgatcgatcgcgttgccaaacgtctgggacgtcgcttgtatgaagtgccggtcggtttcaaatggtttgccgagggtttgttcgacggctcgctgggttttggcggggaagagagcgccggcgcgtcgttcctgcgcaaggacggtggtgtctggagcactgacaaggacggtctgattccggccttgctcgcggctgaaatgactgcccgcacggggcgcgatccaagccaggcttatcgcgcgctgaccgatgaactgggcgaaccgttctcggtgcgtgtcgatgccaaggctaatcctgaacaaaaagccttgctgagcaaactgtcgccggcacaggtcacttccactgaactggcaggcgagaagatccagagcatcctcagccacgcaccgggtaacgatcaggcgattggtggcttgaaagtgatgaccgaaaacggctggttcgcagcgcgtccatccggcaccgaagacatctacaagatctacgccgaaagcttcgtcagcgacgaccacctcaagcaactggtggccgaagcgcagacgttggtggatggcgctatttcgaccaaatgatccgagcctgcagataacccagtagagaggggataaatctccccaaaatacggagtttgcaaagcgaagataaaaaaggggcaaccgtcatggttgccccttttttgtggctcgcgttcaaacgatcaagccagatccaccaaaacgatttcactgtcttcaatcgccgtgacggtcagcacctgctcatgcgcaaccgcgacaccgtctcgagcttgcgcacgcaagccgttgacttcaatcacgccggttgctggcaccagataggcgcggcgtccttcatccagtcgatactctgcggtttccccagccttgatattcgcagccaccaaacgtgcatcggcccgtatgcgcaggctctggtcatcgccgtccttgccgctggccaatgtcacgaagccttcacgctcgccctttggaaacggttttgcaccccacgaaggcggcgcgccggtttcggtgggcagaatccagatctggaagatcttggtgtcatgcgcttccaggttgtactcgctgtgcgcaatgccggtgccggcactcatcacctgcacgtcgcccgcttcagtacggcctttgttgccaagattgtcctggtgagtaatcgcaccttcacggacgtaagtgatgatttccatgtcgcggtgcggatgctgcggaaaaccggtacctgcggcgatgatgtcgtcgttccacacgcgcagattgccccagctcatgcgctgcgggtcgtaatactctgcgaacgaaaaatggtgatgagcatccagccagccgtgatgggcgccgcccaacgagctgaaaggtctgagttcaagcatgatcgtctcctcaaaaggctcgtcatggggcgcgatggttgcacccgacacgagaccgttggtttatgacggcaatcatctatcagttaatcatcgataaaaagcgtaaaaagtgcggcattattatctaagttattgatgagaacatcactcgaaatcgtctggtctcaccttcaattgatcgcctaaaccaatgacctgtaagcatttcgctagaactcaacggcaaatacagacaccatagacgcaacagcctcacacactggagcccgtcagcgtggcgcaacacactcccgatcttccctccgagcttcgccctttggccgagatgccatggttcaaacgcttggccgcgcgcttttttggccacggattgacgcgattgcgcgcccagcatcgtgcttcatggttgcatggccaggcagatggctttcgcagcgggcacaccgctggcgtcgaatatggctttagagaaggcaagctcgaaggtctggaggagggtcggcaagtcctgctgatccgcgacagccgaagcaccgagcatcgtccgccgagtgtcgacaatcatctgttcgacgattggcggctgccgctgacggccgagctgaaaaagcgcatgaaggccgatgtcgcgcgtttgttgcctgagcatgcgcaaccgagcgttgcgcaatggaaaatgatattcagcgatacgccgtcgacctcggtggtggctggcgccggtgccggcaaatccaccacgctggtgttgcgcatcctgctgctgacccattacctcggcttcgagctggactcgatgacggtggtgaccttcactcgcgagtcgcgtaaggatttcgtcaataagttgatcgagctgttcgcactctggggtcaggcactcacactgaaacaggcgcgcgagctggtgcgaacctttcactcgcggatcttgccgatgattcgcagcctgcccggattcgagcgcttgcaggcattcgagaaccttagcctgcggccacagggcggcgacgaggaggttgatagcaatcagttcgacctgcgcatcaacgatgcgcaacgccaacaattgaacgcctgctatcaccgtttattcaacgaggacgagcgtttccgccagttgattcaaccgctgtcgcgcgcaggattgcagctcaaggagctggagcgcgatcatcctgacgtacagaaacgcatggcggtgaccgaattggcagccaagcgcgacgaggaactgtgcgatgccatcgaggacctgtggttgcgcgccggcgcctggccgatcaaaggcattgagccgaaccggcagacctttgatatcaatgggtcgacgttccattgccacgggtatattccgacactcgatgcttgggtagtgcttggctttgatccccgggagaaccctcaggcttgccgccccaacgccaagctgtcagttcgggcggagtgggcagtaaagcgcaccctgtttcaagctttctgtcgtaagccattgatctggatagatagttacgaatcatcaaagcgtgttttagcgaccctggcaggcgatgccagcgcggggcccgggttcgactacaaggtcaaaggcgagttggcatcggcgcctttgctcgattgttttgtcgccgccgcaggctttatcgagaatctagggctggatgttccggacgctgtcgggcgcatgagttttgccaaggacgacacggaccggtttttctttgaagccctgagcctgttctggcgggcgtttgaagatcatttgctggaccagaaaccgccggtgatgacgtacaaccgcatgtttgcgctgttcagcgagcattcgccagagaatctcaagctgttgagtgatgagctgctgcggccgatgtcgcacctgatggtcgatgaatttcaggatgtgtcgccacagatcgtctcgtggatccgcgccagcctgactgaaatccgcagtcgtggaccggcgatgcacgttggtcggggagcgcagcgctcgtcgttgttatgcgtgggggacgactggcagtccatctacggatggcggggcagttcgccgagttacttcatggagttcaacaaggaattcccgtcgccgagtaccacgcgggtgatgctcagtgagaattatcgcagtcatcaacacatcatcgacgcggccgagcacattgtccgggcagcgccggcgattcccggcaagaaggccaaggccagcggcgagccgaagcatttgcagccggtcaacgttctgcaacgtgatgatcaggacttggggcggcgccttgccgaacactaccgccaaggtcattcaatcttgatgttgtatcgaaaaagcagcgataagccattgattgaagagcatattcaagcagtagttaatgttgattcgagtttaccgtacgacgctcgcaggctgaagcaattgacttatcacagtgccaagggtctgcaagccgatgcagtgtttctgctaggtgattgccagcatctgaccagttcgccttacaagaatcaggtctaccgcatggccgggctgggcaaaaatggcgacagcgaaccgtatgacacggcgcaaaaggacgaaatcctgcgcctggcttatgtcggtattacccgcgctgtcagtcattgttattggtatgtcgagccgcaggacactcaggccgttaacatgccacgggcttccgaccgggtaagcaaaggcaaagcgttcttcgccgatcaccgactggaaaagtctatcgcctgaccataaaaaagcccgcaagaatgcgggcttttcgtttttaatcagatgcttatgcgtagctcctgagggactctggaggtacaaaggcttccaactcatcctccaccgcttcaataattcgctcgacatcagcggcattcatcaccgtagcgcacggtatgccggcgatggcgatcatcgtttcaccactgactcgatcgaacaaacgggcaatcatgctgcccggcgcatccattgttgcctcgaaacccatgggatgaaaatgccagcgcatcagctggcaagcgttggggaacgtgactttgcttgaccctttattcatgtgttgcccgccttcttcatcgagcgcttccgtttgctcatgttaggtgggaagagccttcattggctcaaccggtgactgacattaaaagtagcatctcgatgtgaaattcctgtgagagttttcagttcatttggcgattgctttgatttttttgatgtatgtcacgctcgttgagcgtcatggtcaaatggccactatctatgggccattgctgccagtgtcgaatttgggcaagctcgactcttttgcgatgagcattttatgcacgccgaagacgacggccccgaccagagcgaagccacgtccgccacggtcatgcgctaccacttgagctggaagcatcgggatctggacagcgtgatggcgctgtatcacgcggatattcaatacaacgatttttttcagaaccgtgttctcggccttgaagagttgcgcgagtacgtgcgcgtcagcatgccgcgagaatccgacgaactgctcgagcattgcgatcgaattcgcgtggatggcaacaccgcgttcattcaatacgaagtgactctgcgtggcggtgaggggctggtgtcatttcgttccagcgaagcaataacggtcaaggacgggctgatctggcgcgtcaacgaatatgcttctctggtgcgcacacaaagcaatggcagcaccgcggcgagccagcggccggcagtcagtcgcctgggtttgtcgccacgccaactgagtttcatggctgaagacctgcagcaatacttcgaaaaacaacaagcctatctcgatcccgaactcgacctgcagcgagtagcgaaggagtgcgggtacagtcgcaatcagatttcctacctgctcaatcaggtgttggggcaaagtttctaccgttacgtcaatcaggcgcgcctgcagcatttgctgcgttcgctggacaatgccgcgccacccgtgcgcatcgatgagctggcgttcgccgccgggttcaattcgttatcggcgttctacagctgtttccgccagcacaccgggcagtcaccgaaggcttacgccaaacaaatttctttgcggacacgcgcgcaagacatcggctgaactcacgcactaggatcgacgccatcgaaggttttcagtggcggagtcttgcatgccggcgtggcgcactatcagtttgtggatggatcaactcgatgagccgctgattgcgcggcctgagcttgagcgggacctggacgtcgacgtggcgatcatcggcgccggctacaccggattgtggactgcgtattacctgaagaaactggcccccggcctgaacattgccatcgtcgaggcgcaaaccgccggcttcggtgcttccggccgcaatggcggctggctgatgggtaatctgctcggcgaggatcgactgctggccggtttgtcgccagagcagcgccgagcctcgttcgatctgctgcacagcattcccgatgaagtcgaggttatccttgagcgtgaaggcatcgcctgcgactaccgcaagggcggcgttctttactgtgctgcgcgctatccggaacaggaagctaccctgcgcgactacttgagcaaactgcacgcccaaggcttgaccgacaacgattaccgctggctcagccccgagcaactggcgcagcagatccgtgtggccaagccttatggcggcatctatgcgccgcacgtggcgaccatccatccggccaaactggtgcgcggtctggcgcgggccgtgcagaacatgggtgtgaaaatctacgaaaacagcccggtcacgcattggcagtcgggcagcctccgtactgcgaaggccagcgtgcgcagtcactggatcgtgccggcagtcgaaggttattcggtgaccttgccgccgttgggtcgctatcagttaccggtgcagagcctgatcgtcgccaccgagccgttgtctgccgccacttgggatgaaatcgggctcaatcgcgggcaagcgttcagcgagttcagccgccaggtcacgtatggccagcgcagcgccgacaatcgcctgatcttcggcgcccgtggcggctaccagtttgccggcaagctgcggcacaactttgacctgacccgcgatgaagtcgaactgcgccgttatctgttcggcgagctgttcccgcaactgaaaaacgtgcagatcacccacgcctggggcggcaacctcggcatgtcccgacacttcaaaccgcacatgctctgcgaccgcgccaacggtattgcattgtcgggcggttatggcggcgagggcgttggcgccagcaatctcggcggccgtaccttggcggatctgattcttgagcgtgacagcgaactgactcaacagccatgggtgctgcccgacggcgcgattcatgcgttgcgcgcgtgggagccggagccatgccgctggctcggttacaacgcaatcatcaaaagttttgtccacgaagaccagaccctggccaacccggcgaccgcgccatggcggcgcaagcttgccagtcaggtggcgggcttcatggaaggtttcatgcactaaacgtcgtttatcgaacagacaggtcagaccatgagtattacgcaattcaagaacaccgcgacattgccactcgacgaatccaatccggtggcggtgccgctgggcgagccggtcgcggttgcctcgaccaccagcgtcgagcgcgacgacggcgtcgaaaccggcgtctgggaatgcacccccggacgctggcgccggcagatcaccgcacaggaattctgccatttcatttccgggcgctgcacgttcaccccggacggcgggggtgaaaccctgcacatacaaggtggcgacgcactgatgttgccggccaactcgctcggcatctgggatatccaggagaccgtgcgcaaaacctacgtgctgattttctgatcgcttgatccctttgattgcctgccaacaaaaaaacctacacaggaatcgccccatgatccgaaagacccttgctctggcaccgctgatgcttgccgtttccctcgctcaggcggcggaaacggtcaaggtgtacaactggtccgactacatcgcgccagacaccacgaagaattttcagaaagaaaccggcgtcggcgtcacgtatgacgtctacgacagcaacgaaaccctcgacggcaagttgatgaccggcaaatccggctacgacgtggtctttccgtccaaccatttcatggcccggcagattcaagggggagcgctgaagaaactcgacaagagccagttgccgaactggaagaatctcaatccagtgctgctcaaggccttgcaggtcaacgatccgaacaacgagcatggcttcccgtatctatggggcagcaccggcattggctacaacatcgcgaaagtcaaagcggtgctgggcgacaacgctccggtggattcctgggacttgatcttcaagcccgaatacatggagaagttgcagaagtgcggcgtggcgattctcgacaacggcccggaattgctcccggcagcgctcaactatctgggcttgccgccccacagcaaaaatcccgaggactataagaaggccgaagccttattgatgaaagtgcggccttacgtcagctatttccattcctcgaagtacaccagcgacctggccaacggcgatatctgcgtggccgtcggcttctccggcgacatcctgcaagcggaaaaccgcgccaaggaagccaagaacggtgtcgacatcggctacaacattcccaaggaaggcgcggcaatctggttcgacatggtcgccatgcccgccgatgccccggacgagaaggccggttatgcgttcatgaattacctcctgcgcccggacgtcatggccagcatcagcaactacgtgcactacgccaacggcaacgagcaagccgacagcctgatcgatccggcaatcaagaacgacaccaaggtttatccgagtccggagatgatgggcaaattgttcgcgctggaagcaatgccgctgaacatcgaccgcatccgcacgcgggtttggaacaagatccgtacgggtagctgactcgcttttcccctgtaggagctgccgcaggctgcgatcttttgatcttgcttttgaaaggcaaagtcaaaagatcgcagcctcgtttcactcgtcagctcctacagtttgggtgagccgtttggttgatatcaatacactggcatcgcactaataaagtgcagcaaattgagacgcgcctaacaaaaaacaacttacccatatttaatatttaaatagaaaatcgtcagacaattaggcaaaagccgcacaactaaaacattctttcatcgccacacgctttgtttacggcagtttcccgaaacactccggtttgatctcaaaaaaatcctttacgtcagatttcaaattgtgtcaggtttctgatgccttcattgggcgagtgataggactatctcgccagagattgtcgctatcggacaaaaactgttccattgctaaacaaggaagtgtgtttatgtcgaaagttaaagctaatgctattgataccgccgaacaggcttttttgctgtctgcggcgccgcaacctctggccgcagccagctcggcgtttaaccagatcgatagcttcagccaccaatacgatcgtggcggcaacctcacggtcaatggcaaaccctccttctccgtcgaccaggccgcaacccagttgctgcgcgacggcgctgcctaccaggacaaggatggcagcggcaagatcgaactcacctacacgttcctgacttcggcatcgtccagcacgatgtacaaacacgggatcagcgggttcagtcaattcagtgcacaacaacaagcccaagccaagctcgccatgcaatcctgggcagacgtggccaacgtgaccttcaccgagaaagcctcaggtggtgacggccacatgaccttcggtaactacagcggtggccaggatggcgctgcagcgttcgcctatctgccaggcaccggtgctggttatgacggcacctcgtggtacctgatcaacagtggctacacgcagaacaagaacccggatctgaacaactacggtcgtcagaccctgactcacgaaatcggtcactcattgggccttgcccaccctggcgactacaacgccggcaatggcaacccgacttacaacgatgcgtcctacggccaggacacccgcggttacagcatcatgagttactggagcgagagcaacaccaaccagaacttcagcaagggcggcgtagaagcgtattcctccggcccgctgatggacgatattgctgcgatccagaagctctacggtgccaacaccaccacccgaaccggtgacaccacctacggcttcaactccaacactggtcgtgatttcctcagcgcttcgtcgtcgagtgacaaagtggtgttctcggtgtgggacgcgggcggcaaggatactctggacttctcgggcttcacccagaaccagaagatcaacctcaatgacgcctcgttctccgacgttggtggcatggtaggcaacgtgtccatcgccaagggcgcgatcatcgagaacgccatcggtggttcgggcaacgatctgctgatcggcaacagcgtagccaacgagctcaagggcggtgccggcaatgacatcctctggggtggcggtggtgctgacaaactgtggggcggtgcgggttcggacacgtttgtgttcgcagccagttccgactccaagccgggtgcgatcgatcagatcctcgatttcgtcagtggtctggacaaaatcgatctgaccggaatcaccaaaggcgccggcctgcacttcgtcaatgccttcaccggtgcggcgggcgatgcagtgctgacttcgtcgggcggtaacagcctgctgtcggtggacttctccgggcatggctcggctgatttccaggtcagcaccgtaggccaggcggcattcagcgacatcgtagcgtgatgtgaagcaggaaagcggcgcgtgatgcgccgctttctctccttgcatcgtgttgctctgtaagcaaggctacacgccggagcgaatattcccatgatctacaaagcttttccctacaaggcaatggcgtggctcgtggcggcgctgatcacgatttcaggagaaaccagcatggcaagcagcctcagactcgaagaaccctcggtgttggccggccagtggcaggcaacgttgtctacccgggatgaagacccgcaaacgcaacagcagcaggacaagccttcgaatacttgcctcgtcgaattgctcgcaaacaagactttgggtcaaggcgctgactgcctgggcgcatggcttgatgaaacacctatcggctggtttcccgatcctgacggcctgtcgatcaccggcaaggaaggttcaagaatccagttcttcagccgacaacgtggcgggctttacttgaccactttgaagtcgggtctggtgatcacgttaacgcacacagtgaaacagccttgattatcgaatccgcgacaaagttttaatataaagcgccacaagctggttataagagacgccgaatgacaactgcaccgctgttaattacgcaagttgttatgaaagtgtaagcgggtacttgcaagtcatctttcgcaggtaagcggaacattaattgaggcctcgtccaagtgtggcgagaccgaacatttcaggaagaatcaatgaagatggcgaaggccccagccaccgctccgttattcaaggctttgggtgactataaaagcatcctgatcagcgtcggctgctttaccgcgctgattaacgtgctgatgctggtgccctccatctatatgcttcaggtctatgaccgggtgctgtcgtcgcagaacgaaacgaccctggcgatgctgtcgttgatggtcgtcggcttctttgccttcatcggcatgctggaagtgatccgcagctttatcgtgatccgcatcggcagccagctggagcgccgcttcaacctgcgtgtttaccaagcggcgtttgaacgcaatctgttcaagggcgagggcaacgccgggcaatccctgggcgacctgacgcacattcgccaattcgtcacggggcctgcgctgttcgcgtttttcgatgcgccgtggttcccggtctatctgtttgtgatctacctgttcaacgtctggctcggcgtgctcgctaccgcgggcgcactgttgctgatagggctggcgtgcctgaacgaatacatgaccaaaaagccgctgggcgaagccgccggttattcgcagaagtccagccagttggccaccagccatttgcacaacgccgaaactattcaggcgatggggatgctcggttccctgcgcaagcgctggttccaggtgcactcgcgtttcctcggcctgcaaaatcaggccagtgacaccggtgcggtgatcagctctctcagcaaaaccctgcgtctgtgcctgcaatcgctggtattggggctgggcgcattgctggtgatcaagggtgacatgaccgccgggatgatgatcgccggttcgattctgatgggtcgtgtcctgagcccgatcgaccagttgatagccgtgtggaaacagtggagcggggcgaagctggcttaccgccgtctcgatgcactgctgcaagcgttcccgcccagcgacgacgccatggcgctaccgccgccgaaaggccagatcaccttcgaacaggtcagcgccggcccaccggggcaacgtgcggcgaccctgcaaatggtcaatttcaatctgaatgccggcgaagtgctcggcgtgctcggggcttccggttccggcaaatcgacgctggcccgcgtactggtcggcgtgtggccaaccctcggcggcacagtgcgcctcgatggcgccgatattcatcgctggaaccgcgaccagctcggcccgtacatcggctacctgccgcaagacatcgagctgttcagcggcagcatcgccgagaacattgcccgtttcagcgaggccgatccgcagaaggtggttgccgctgcgcaacaggccggcgtgcacgaaatgatcctgcgcctgccgcaaggctacgacacgcaactgggcgaggacggcagtggcttgtccggcggccagaagcagcgcgtggccctggcgcgttcaatgtacggcacgccgagcctggtagtgctggatgaaccgaactccaacctcgacaccgtcggcgaagcagcgctggccagtgccattgccgcgctcaaagcccagggcaccacggtggtgctggtgacgcatcgctcttcggtgctggcccaggctgataaattgctggtgctcaacgacgggcgtctgcaagccttcggcccgagtcaggacgtgcttaaggcactctccggccagcaagaacaacaacgggaaaaagctgcacaggcaccgggcgggctcagcatgagccgacagtatcagccctcgacaaggaattcgggtgtatgagcagcgcaagcatgaacactgaaaacgaagcgagcatggagcacgcgtacatcaccgaacgcccggaacgcgacgctaaattcttcgcgcgcatgggctggattctggcgatcgttggcgctggcagtttcttcacctgggcggcgttggcgccgctcgatcaaggcattccggtgcagggcaccgtggtggtctcgggcaagcgcaaagccgtgcagtcaatgagcagcggtgtggtcagccggattctggtgcgcgaaggcgaaatcgtgaagcagggccaaccgctgttccgcctcgatcaaacgcaagtcgccgccgatgtgcagtcgctgcaagcgcagtaccgcatggcctgggccagcctcgcgcgttggcaggccgagcgcgacaacctcaagcaagtgacctttccggcagagttgagcaacgacccggacccgcgcctggcactggttctggaagggcagcggcaactgttcagcagccgtcgcgaggcgttctatcgtgagcaagcggcattgcgcgcgagcatcgaaggcgccaccgcgcaactggccggcatgcgccgcgcccgcaccgatctgaatgcccaggccgactcgttgcaacaacagttgagcaacctgcaaccgctggccgacaacggttacattccgcgcaaccgtttgatggaataccagcgtcaactgtcgcaagtgcagcaacaactggcggaaaacaccggcgaaagcggccgcgtcgagcagggtatcctcgaatcgcgcctgaaactgcaacagcacggcgaggaataccagaaggaagtccgcacgcaactggccgaggcgcaactgaagagcgtcaccctttccgaacaactgacgtcggccggtttcgacctgcaacacagcgaaatcatcgctaccgccgatggcgtcgccgtcaatcttggcgtgcacaccgaaggcgctgtggtgcggcagggggaaaccctgctggagatcgtcccgcaaggcaccacgctggaagtggaagggcacctgccgatcaacctcatcgacaaggtcggcacgcatttgccggtggacatcctgtttaccgcgttcaaccagagcaaaaccccgcgtgtacccggcgaagtcagcctgatttccgccgaccagatggtcgatgagaaaaccggcgtgccttattacgtgctgcgcagcagcgtcagtgatcaggccatggaaaaactcaacgggctggtgatcaagcccggcatgccggcagaaatgttcgtgcgcaccggcgaacgttcactcctcaactatttgttcaaaccgctgctcgaccgggccggctccgcgttgaccgaggaataaggatgttcggctgtatgaataagctttccatactcggggcggcaatgatgctgctcgcgagtcactcagcggtagcggccatggggccgtttgagatttacgaacaggcgctgcgcaatgacccggtgttcctcggggcgatcaaggagcgtgatgcgggtctggagaaccgcgccattggccgtgccggcctgctgccgcgcctcggttacacctataacaaggggcgcaactcgtcgaaagccacttccctggatgaccgcgcgcgcaaccgcaccgacgaccgcaactacagcagttacggctcggccttgaccctgcaacaaccgctgcttgattacgaggcttatgccgcgtaccgcaaaggtgtcgcgcagtcgctgtttgctgacgaaaacttccgtggcaaaagccaggaattgctggtgcgcgtgctggataactacaccaaggcgctgttcgcacaggatcagatcgacatcgctcaggcgaagaagaaggcgtacgagcagcagttccagcagaacgaacacatgttcaagcagggcgagggcacccgtaccgacattctcgaagccgagtcgcgctatgagctggccactgccgaagagatcgaggcgcgtaacgagcaggatgccgcgctgcgtgaattgggcgcactggtcggcgcaccggcggtggatatcggcgatctggcgccactggatcagaacttccagaccttcgccctgcaaccggccaattacgatacctggcacgagatggcggtcagcaacaacccgaatctggcttcgcaacgtcaagccgtggaagttgcgcgctacgaagtggagcgtaatcgtgccgggcatctgccgaaaatcaatgcctatgcctcgatgcgccagaacgagtcggaaagcggcaacacctataaccagcgctacgaaaccaacaccatcggttttgaagtcagcgtgccgttgtatgccggtggcggtgtgtcggcgtccacgcgtcaggccagccgcagcatggaacaggcggagtacgagcttgatggcaagacgcgcgagacgttgatcgaactgcgtcggcagttcagcgcctgcctgtcaggggtgagcaaattgcgcgcttatcagaaagcgctgagctcggctgaagcgctggtggtgtccaccaagcaaagcattctcggtggtgagcgcaccaacctcgacgcactgaacgccgagcagcagctgttcactacgcgccgcgatctggcgcaggcgcggtacgactatttgatggcctggaccaagttgcattactacgccgggaccttgagcgagcaggatctggcgcgggtggatgaggcttttgtggtcgctcaacagccctcaccctaaccctctcccagagggagaggggactgatcgggggatattgcagacgtacaccgacctgaacgagcgtcacccgaatccaacaccgacccggtttttcaggtcgatgaacgacgcaagacacctcggtcagctccctctccctcgggagagggctggggtgagggaaatgctctaccgaatccataatcgacgcggtgtttcaggtcgatgtaaggcgcaagacacctcggtcagctccctctccctcggggagagggctggggtgagggggacaggcaacaccgcaaaagaacctgcataaaacaataaaagtgagtggtgaacatggacgtacgcatcaagccgatttcggtcggcaccctgctgcttgtgatttctgcaaaccaggttcaggcgcaatacctggaaaccggtaaacccggcaacgccgccagttggcgcagtgccgaattcctccgtgactggggtctggagcgcatgcaggccgaccaggcctacgccgccggcatcaccggcaaaggcgtgaaaatcggcgcgctcgattccggtttcgctgccgaccacccggagttcgccacggatcgttatcacccggtactggcgagcggaagctacgttgacggcacgctgttcaacgtcgatggcaccctcaatcccaacaacgactcccacggcactcacgtggtcggcaccatgggcgcctcgcgcgatggcggcggcatgcacggcgtggcgtacaacgcgcagatctacgtcggcaacaccaacaagaacgacagcttcctgttcggcccgaatcccgatccacgttatttcaaagcggtgtacgacgccttggccgatgctggcgtgcgggcgatcaataacagttggggcagccagccgccggatgtcagctaccgcaccctcgcggatcttcacgccgcctacgcgcagcactggaaccaaggtacctggctcgacgccgctgccgatgtctcgcggcgtggcgtgatcaacgtgttcagcgccggcaacagcggctacccgaatgccagcgtgcgctcggcgctaccgtactttcagccggatctggaaggtcattggctggcggtgtccgggctcgatcagagcaatcagcagaagtacaaccagtgcggcatcgccaagtattggtgcatcaccacaccgggggcgaagatcgacagcaccattcccggcggcggttacgcgatcaagtccggcacctcaatgtcggcgccgcacgccaccggcgctctggcgctggtgatggagcgctacccgtacatgaacaatcagcaggcgctgcaagtgctgctgaccactgccacgcaactggacggttcggtgaccgacgcaccgacagaacgagtcggttggggcgtggccaacctgcagcgggcgatgcgcggcccggggcaattacttggcgcgtttgacgcgaatctgcctgccggacagcgcgatgtctggagcaacgacatctcggataacgcactgatccagcgtcagcgcgaagacctcgccgaacacagcgcctggcagcagaccctgcaggccaaaggttggcaaaacggcatcccgagcggcgccagtcagcgggatcagagcgattacgcggtcggcatggcccgtgatgcagcggcagcgacgcgggtgtatcagggcagcctgatcaagtccggcggtgggcaattgctcctcagcggcgacaacacctatcgcggcccgaccacggtcaacggcggtttgctcacggtcaacggctcgctgacctcggcggtgacggtcaacgccagcggcaccctcggcggttccgggcgcatcggcgcattgctcgccaacagcggcggtcgcgtggcgccgggcaattccatcggcaccttgaacgtggccggcgatgtgactttcgcagcgggttcgacctacgcggtggaactgtcgcccaccgccagtgaccgcatcgtcgccggcggcagcgcgaccatcagcggcgctaccgtcagcctgtcactggaaaacagcccgacgctgctgagtactgcccaagtgcaaagtctgctcggccatcagtacaacattctgcaagcggccggcggcattcagggccagttcggcgcggtgttgcccaactacctgttcatcggcggcagcctcgattacgccgccagcggcattcaactcaacatcgaacgtaatgccacatccttcgccagcgttggccaaaccccgaaccaacgctcggtggccgctgcgatcgaagggctgggcgccgctaacccggtgttcgaaagcctgctgctgtcgtcatccgcggcatccgcgcaacaggcgtttcaacaattgagcggcgaaatctacccggcgctcggttcgatgctgatcaacgacagtcgccaattgcgcgatgccgtgggcgagcgtttgcacaacgcgacggcggcgcaaagcaatggctgggtcaaagcactcggcgcctggggcagcaccgattcaagccacgacacggcgggttacagcacttcgattggcggcttgctggctggtgtcgacggcgcgctggatgagcagacacgcattggtctggtgacgggttacagcgacagttcgttgagcatgggctcgggcacgcattcttcggccaaggtcgacagctatcacctcggcgcctacgcgggccacgacatcggcgcgtggcgactgagcactggcgcggcgtacagctggcatcgcggcgacgtcaaacgtgatctgcagtacggcgaggtcagcgccaaacagaaggccaaggtcgatgcgagcaccacgcaagtgttcggcgaagcggcgtatcaactccacctgcaaccgttggcgctggagccgttcgccaacctcgcctatgtgcacgtcgacacagaagggtttaccgagaagggcgatgccgccgcgctgaaaagctcgggcgatcagcgtgacgcggtgctcagcaccctcggcgtacgagcgatcaagaccttcaatctgtcgccggcgcaatcgctcgatgtcagcggccatctcggctggcaacacagcctcagcgacatcgatgccgagcaacacctgcgcttcgccagcggcgccacgccttaccgcgtcgagagttcggcgctggtgcgcgacgccgcgctggtcggcgtgcaagccagtctggcgctgagccgcgacgtacgcgtgaaccttgattacaacggacaactggccagtcgcgagaagcttcatggcgttggcctgagccttaactggcagttctaagcaagatatcccggcaatgatcgttcccacgctctgcatgggaatgcctctagggacgctctgcgtccagtgacgcggagcgtcaagggctgcattcctttgctgcgcgtgggaacgatcattgctctgcgtgggaacgatcaggatttttcgcaacatcactaaggaaggtcgctggatgaataacaacaatacccccgcgcaaacgggtggccgttttgccctgaaaaccctgacattcgcggtgttgtgcgctatcggcacggcgcaggccgcgccttacgtggaaaccggacgcagcggtgatccttcaagttggcgcagcaacgagtttcaggccgattggggcctgagcgccatcggtgccgattacgcctacgccgctggctacaccggcaaaggcgtgaaactgggcatcttcgatcaaccggtctacgccgcgcacccggagttttccggcagcaataaagtcatcaccctggtcaccagcgggatccgcgaatacaccgacccgtacattccggtgaaagcgggcgacgcgttccgctatgacggttcgccctctgtcggctccgatggcaaactcggcgcccacggtactcacgttggtggcatcgccgccggcagtcgtgacggcgggccgatgcacggagtggctttcggggcgcaaatcatcagcgccgacaacggcgacccgggcccggaagacggcattgtgcgcggcaacgacggcgcggtgtacaaggccggttgggatgctctgatcgccagcggcgcgcggatcatcaacaacagctggggcatcggcatcaccgaccgcttcgacctcggcggcaaggatccggcgtacccgcacttcaccgtcaatgacgcgcagttgcagttcaacgaaatccgcacgttgctcggaaccaaagccggtggcgcgtatgacggtgccatcgccgccgcacgcagcggtatcgtgacaatcttcgccgccggcaatgactacaacctcaacaatccggatgccattgccggcctcggctattttgtcccggagattgcgccgaactggatcaccgtcgccgcattgcagaagaaccctgatctggccagcgccaatccgtacatcatgagtacgttttcctcgcgttgcggctacaccgcgagcttatgcgtctcggcgccgggcacgaaaatctacagcgcaatcatcgaaggcaccaacgccgacaacctgaccaccggctacaaaaattacaacggcacctcgatggccgcgccgcacgtggccggctccatggccgtgctgatggaacgcttcccgtacatgagcggcgatcaggtcgccacggtattgcgtaccaccgcgaccgacctcggtgcaccgggcatcgacgccttgtatggctggggcatgatcaacctgcgcaaaggcattgatggcccggccatgttcgtcaccgagacagacattcctgaggagttccgcattcagggagcctatggctccggccagtttgtcgcggatttgcctggcatcggcgcgatcatcgatcaaggcaaaccgaccgagcgtctgtgcagcgacatcacctgcggcctcgacacctggcgcaacgacatttccggccacggcggcttgaccaagcagggcatcggtacgctggtgatgaccggcaacaacagctacaccggcccgacgctggtcaatcagggccgactggccatcaacggtacgctggcctcggcggtcaccgtgaatgacagcggcatccttggcggtaacggccgcatcggcgcactgtcggtgaaaaacggcggtacggtggcgccgggcaactccatcggcaccttgaatgttgcgggtgacgtgaccttcgagccgggttcgacctatgcggtggaagtctcgccgaccgccagcgacaggattgtcgccgatggcaaggcagtgatcgagggggccacagtcagtctgtcactggaaaacagcccgacgctgctgaccaccactgaagtgaaaagcctgctcggtacgcagttcaatatcctgcaagcggcgggcggtatcgaagggcaatttggccaggtgctgcccgactacgcctttctcggcggcaccctggcgtattcggccagtggcgttcagttggaggttgggcgtaatggcgcgtcgttcgccagtgtcggtctgacgccaaaccagcgagcggtcggtgcggctgccgagcggctgggcgcaggcaatgcgctgttcgaaacactgctgctgtcgcccaatgcggccgtggcgcaacaagcgttccagcagttatccggtgagattcatccggcgatcggcacgctgttgatcaacgacagccgttacctgcgcgaggcagtcggcgagcgcctgcgcgagcgtgatctgttcaacgccgatgcaccgactgatgatcgcagcaatgcctgggtcaaggtgctgggttcgtggggcaccagcgatggcggcaataaaaacgcggactccaccagttccatcggtggtctgctggccggtgtcgatggcttgattgctgaagatacccgcctgggcttcgttactggttacagcgacagttcattgagcatgggcagcggcacgcattcgtcagcctcggttgacagctaccacctcggtgcatatctggggcatcaaatcgatgcactgcgcctgaccgttggcggcgcctacagctggcatcgcatcgacgcgaaacgtgatctgcagttcgctgacgtcagcggcaagcagaagaccaaacgcgacgcgagcacggcgcaattgttcactgaagccgcttacgatctgggcttgcaaccgatgaaccttgagccgttcgccaacctgtcttacgtgcacctgaacaccgacagctttaccgaaaaaggcgatgccgccgcgctcaaaggtggcgaagacaaccgcgatgtgctgttgtcgacgctcggcgtacgcgccaagcgcagttttgctctgtcggaccagcatcaactggaactgggggcgagcctgggctggcagcacaacctgagcagtgtcgacgctgacagccatctggcgtttgccaatggcaacagcgcgttcaccgtgcagagtgtgtcgatggatcgcgacgccgccgtagtcggcgtgcgggcggggctggcgctcaaccgcgatgtgcgtgtgaacctggattacaacgggctgatcggcgcgaacgagaaggaccacggggtgggcctgacgcttgactggcagttctaggcagcgccggcagttccagacgaaactgccgggttttttaaaggaagagagggcacaacatgggattgttcgattacaggaatgccgatggcaaagcgttgtacagcgacgccatcgcactcacgctgtatgcctacacgccgaccggccagccattgccggcgacgggatgggcacccgttgccgcgaccgcgctgggttatcaaggcaaggtcggggcgcagggtacgttcttcggtgagaaggacggcttcaccagcgccgaagccgaagtacttggcaaatacgacgccgccggcaagttggttggcatcggcgttgcctttcgtggcaccggcgggctgggttatagcgatacctttggcgacatgaaaaacaacttgctggcagcgatcggaccatcggattacgccagcaactacgcaaaaaacgctttcgacaatctgctcaaggctgtcgccgcgtttgccattgccaacggcatcgccgccaaggacgtgttgatcagcggccacagccttggcgggctcggggtcaacagcgtggccgaattgagcgcgagcaactggggaggtttcttcaaggacgccaattacattgcgttcgcctcgccaacccagagcagcaccggtaataacgtgctgaacatcggttacgagaacgatccggtatttcgcgtgctcgatggcactacgttcagcaccgcgtcgatgggcaagcacgacaaaccgcatgattcgaccaccgacaacatcgtcaacttcaacgacaattacgcctccaccgcgcaaaacctggtgccgttcagcatcgtcaatccgctgagctggtcggcgcacggctcgctgggctatgccgatggcctgaatcgagtgatcgattcgaagttctacaacctcaccggcaaggactcgacgatcatcgtctccaacctggaagcgtcgtcccgaggcaagacctgggtcgaggatctcggccgcagtggcgagccgcacaccggcagcaccttcatcatcggcaccgacagcaatgactggctcaaggggggcgcgggcaacgacttccttgaaggtcgcgcgggcgatgaccgtttccgcgatgacggcggtttcaacatcctgctcggtggccagggccacaacaccttcgagctgcagaagccattgcagaacttcagcttcgccaatgacggcgacggcacactgtatgtgcgcgacgcctacggcggcatcagcatgacccgcgacattggtgcgctggtgagcaaggagtcgggttcgtggtggggcagcaaggaaatcacctggggtgtgacggccaaagggctgaccaatggcaatgagctgacgcagtacaaccattcgctcagcggtgatggctacggcaatgcgctgcatgcgacggctgatggcgactggctgttcggtctcggtggcgacgacagactgatcagcgacaaaggccacgtgaccttcgttggcggcgccggtaacgatgtgatgacggcggttggcggcggcaacaccttcctgttcagcggcgcgttcggcttcgatgccatcaatggttatcagggcggcgacaaactggtgttcatgggcgtcgaaggcgcggggcagggctacgactacaagcaacatgtggcgcagaccggtggcgatacggtgctgaagattggcgactttgccgtgaccctgatcggggtgggagtggctaacctgtcggactctaatttcatgttcgcgtagatccaatgtgggagcgagcctgctcgcgaatgcgtagtgtcagttgaagtactcgtacctgacgcaccgctttcgcgagcaggctcgctcccacagttaaaagcagtaagtagtactgaaatgctccggggcgtccccgtggggcgcactggctgtgagctatctctgaacaattccaacaaagagagaggcaatagcaatgggtgtgtatgactacaagaatttcggcacggacgattccaaggcgttgttcagcgatgccatggcaatcactctgtattcctaccacaacctcgataacggttttgccagcggttatcagcacaacggtttcggcatcggcctgccagccacactggtcaccgcgttgattggcggcaccgactcgcaaggtgtcatcccgggcattccatggaatcccgactcggaaaaactcgccctcgatgcggttaaagcggccggctggacgccgatcaccgcctcgcaactgggctacgaaggcaagaccgatgcgcgaggaacctttttcggcgagaaggccggctacaccagcgctcaggtcgagatcctcggcaagtacgacgcccaaggccatctcaccgagcttggcattgcctttcgtggcaccagtggcccgcgagaaatcctcattggcgactcgatcggcgacgtgatcaacgacctgctcgcggccttcggccccaaggattacgcgaaaaactacgttggcgaagcgttcggcaatctgctcaatgacgtgatggccttcgccaaggccaacggcctcaccggcaaggacatattggtcagcggccacagtctcggcggcctggccgtcaacagcatggccgacttgagcggcggcaagtggggcggattctttgccgactccaactacatcgcctatgcctcgccaacgcaaagcagcaccgacaaagtgcttaacgtcggctatgaaaacgatccggtgtttcgagctctcgacggctcgaccttcaccggcgcctcggtaggcgtgcacgatgcaccgcatgcctcgaccactgacaacatcgtcagcttcaacgatcactacgcctcgaccgcgtggaatctgctgccgtactcgatcctcaacattccaacgtggatttcacacctgcccaccggttacggcgacggcatgacccgtgtactggattcgaagttctacgacctgaccagccgcgactcgacaatcatcgtcgccaacctgtccgatccggcgcgagccaacacctgggtgcaggatctcaatcgcaacgccgaaacccacaagggcagcacgttcatcatcggtagcgacggcaacgatctgatccagggtggcagcgccaatgactatctggaaggccgtgccggcaacgacaccttccgtgacagtggcggctacaacatcatccttggcgggcagggcagcaataccctggacttgcagcaagcggtgggcaagttcgacttcgccaacgacggcgccggcaatctgtacatccgcgatgccaacggcgggatcagtatcacccgcgacatcggcagtattgtcaccaaggaaccggggtttctctgggggctgttcaaggatgacgtcactcacagcgtcaccgccagcggcctgaaggtcggcagcaatgtcacggcgtacgagtccagcgtcaaaggtagcgctggcgccgacacgctgaaggcgcatgccggtggcgattggctgtttggcctcgacggtaacgatcacttgatcggcagcacgggtaatgacgtgtttgtcggcggtaccggcaatgacctgatggaatcggggggcggggcggatacgttcctgttcaacggcgcgttcggccaggatcgggtggtcggttacacgacgaacgacaaactggtcttcctcggcgtacagggtgttctgccgactgaggatttccgtgcccatgccgcgaccgttgggcaggatacggtgctgacgtttggcaacgactcggtgacactggtgggcgtgtcgctcaatagcctgagtgctggcggtgtcgtgatcgcctgatgttgatggggtgccggtaagggccctttcgcgagcaagctcgctgccacactggatctgtgtcgtttacagaaccctgtgggagcgagcctgctcgcgaagaacgatcacgcggtttaaaagtgactcaacagccactccctgactcaaatccctgccaaacaggaaatgcggcctaaagccagcacgtgcacacacgttctatagctagccgccattgagtacaggagattcaaacgtgaaaggtttcaaggggtatatcggcttcgtcgcactggcgctgtgttcggccaatgtctgcgccgatctgcctcaaagctcgattctgagccgctacggcatcaccaccgaccaactgccgagcccgccgaaaaccgaagcagtcgaaccggtcgaagagaaaagccgctttcagattcagcctgaacaaccgttcgtgactctgcgtctgggtgacggcaagcagccgcagaccaccggcaatctgagcattgatcgcatggcgcagcaggatctggaacgctgccggcgtttgcaaggtgaagtggtcaagcggggcggcacgtacatgccttgcgatggcagcattccgggcatgccaaccttcgaataacacaaacatcccctgtaggagctgtcgaaggctgcgatcttttgatccggatcttgtaaatcacgagcgaaagatcgcagcctgcggcagctcctacagatattgcgggggtttcagtcctcttcgcggaccgtcgcgacttcatcggcgcggactttcaccttggccccggaaatatcctcgaactcatagaagccatccttggttttggtcttcggcatgtccttggtcaaatactgggtgccgttctgcaaggtcaccactgtctgggtcgagcaaccgcccagcacgagcagcgcgacgactgccaagggaatgcccagcctgttgattttcatacccacctctacttcctcatgcgatgtgaacccgagcattgtcggtcctgtaacgcggttggtgccactgcgccggaaaaagttcgattgcccggttaaaaaatgccattgatccttttccatttgcaccgggcagggcagagctggtatctgtacgcataaccagtactcgttcgccatggccctgaattcccgtgactgccaatcccctcgacgacccgttctattacctcaacaacttccggcaagtgcttgattggcttgagctgcgctatgccgacgtgatgagcgaaaccgagcacggcttcatccgcgatttcaaggcattgcccaagacctcgcagggcctgctggtgcgcatggtgatgcgcaagggcgtgcactttcgtgtcggtaaactcaattaccctgaaatcggtgacatcgcacacgccgcgcaaccgctgctgaatcatggctggctcgacgaattcgcagcgctgacgatggccgaactgttcgatgtgctgctcaaggccgaggttctccaggcatttggcgcgttcatcgagcaacccaaggggcgcaaggacgattggctgccgctgctcaccgaacagttcgccgatgcccgtagcctgcgcgattgggcgccgttactggcagagcgcctgttcagcctgaccatcatggacctgtgcgatcgcctgcgtctgatgttctttggcaatctttatcaggactggtcggaattcgtcctcgctgatctggggatctttacctacgaaaaagtcgaattctgcgctgattcgcgcggcctgcgcagccgccaggatgtcgacgcctgcctgttcctgcataactgtcagttgcgcttcgaggccggtgaaccgctgcaagccattgtcgagcaagtcggcgccttgcacttcgacaacccctggttgcaacgtcgacgtggcaaggtgttgttccagatcggccagtattgcgagcgcatcagcgagtttgcgctggccttgagcatctaccgcgactgcgcctatccaggcgcgcgattgcgcatgatccgcgtgctggaacgctgcggcgaatacgcccttggcctggaactcggcacgctggctgaacagacgccgcaaagcgctgccgaacagcaaggcctgcagcgaataatgccgcgattgcggcgcaaactcggcgggccgccactcaagcgtacagcggcgaaaccggtcgaacgcctcgatttgcagttgctgcgcagcgatcctgggttgtcggtggagttttacgtgcaggcgcacctgcatgatgacgacggcccggtgcactacgtggaaaacagcctgatcaactcgttgttcggtttgttgtgctggccggcgatcttcgcgccgttgcccggtgcattctttcacccgttccagcgcgggccggtcgatctgctcaatgaagacttccagccgcgccgcgccgagctgttccaggcctgtctcgacgagctcgacgatggtcgctacgcctcgaccattcgccagcgattcgtcgccaaatggggtattcagtcgccgttcgtgttttggggcgcactcaatgagcagctgctcgaacaggcgttggcctgcctgccggctgaacacctcaagcactggttcaatcggctgttgctcgacatcaaggccaaccgcgccggcatgcccgatctgatccagttctggccgcaacacaaaacctaccggatgattgaagtcaaaggccccggcgaccgcttgcaggacaaccaattgcgctggctggagttctgccacgaacaccagatgccggtggccgtgtgctacgtgcaatgggcggagcagagcgcttgagctacagcattgcggtgcgggcgctgtgtgagttcaccgccaagacgggcgacctcgacctgcgtttcaccccgtcgccgacggcactcgaaggcattgccggccaccgtaccgtggcctcgcggcgcaacgagaaataccaaagcgaagtggccctggaaggcgagtttcgccagttgaaggtcaagggcagggcggacggctacgatccggggcaaaactgcctggaagaagtcaaaacctaccggggcgacctgagcaaacaaccggccaatcaccgccggttgcactgggcgcaagcgaaaatctacggctggctgatgtgccgcaaactcgatctgcagcggatcaatctggcgctggtgtatttcgacatcgtcagcgaaaaggaaacctgtctggtcgaggcattcagcgctgaggccctgcaagtgtttttcgagcaacagtgtggcgtgttcctgctctgggccgaacaggaaatggcccatcgcgaggtgcgcaacctggcggcgcagcaactgagctttcctcacgccgagtttcgttcggggcagcggcatctggctgaatcggtgttcaaggcgatcagcaccgggcgctgcctgatggcccaggcaccgaccggcatcggcaaaacccttggcacgttgtttccgatgctcaaggcgctggcgccgcagcaactggacaaagtgttcttcctgaccgccaagacgccgggacgcaaactggcgctcgatgccagccaggtgctgttcgaacagtcgccgaacctgcccttgcgggttctggaaatggtcgctcgggacaaggcctgcgaacacccggacaaagcttgccatggcgaatcctgcccgttggcacaaggtttctacgatcgcttgccggccgcgcgtgaggccgccagccgcatcagtctgctcgatcagcccgccatgcgcgccgttgccgcgcagcatgcggtgtgcccgtattacttgagccaggaaatggcccgctgggctgacgtggtggtcgccgactacaactattacttcgatttcagtgcactcctgttcggtctggcccagctcaatcagtggaaagtcgccgtgctggccgatgaggcgcacaacctcgttgagcgcggacggcagatgtacagcgccagtctcgatcagttcgtccttggcgccgtgcgtaaaaccgcccctgaaccgctaaaaaaatccctgcaacggctcaaccgtgaatggaacacgctgcatgctccgcaactggccgcgtatcaggcctacgacaaggcgccggaaaaactgctgcaagcgatctccctgtgttgcgcggccatcggcgattaccagaatgaccatccacagggactcgacagcgcattgcaaggcttctatttcgagctgctgcagtttgcccgggtcgcggagttgttcgatgagcattacctgttcgatatcagcaagcgcgacctcgagcgcaagcgcccgctgtcgcaactgtgcctgcgcaacgtggtccccgcggcgtttattggcccgcgtctgaaagcggcgcgcagcagcgtactgttttccgccacgctgagcccgcgcaactattacgccgatttgcttggcacaccggacgatacggtgtgggtcgacgtcgaatcgccgttcagcccggcgcagttgcaggtgcaggtggtcagccggatttcaacgcgcttcaatcaccgccaggcgtcgctggagccgattgtcgagctgatcgccaggcagttcggcgagcgtcccggcaattacctggcgtttttcagcagcttcgactatctgcagcaggtcgcaacgttactggccgagcggcatccgcacatcacggtgtggcagcaatcgcgcggcatgctcgaagggcagcggcaggcgtttctcgaccagttcaccgtgcgaagtcagggcgtgggttttgccgtattgggcggggcattcggcgaaggtatcgatttgcctggcgcacgcctgatcggcgcgttcatcgccacgctcggtctggcgcaactcaatccggtcaatgaacagttgaaacgccgcatggcggcaatcttcggcgccgggtatgactacacctacctgtatcccggtgtgcagaaagtggtgcaggccgccggccgggtgatccgcacacgcgaagatcgtggtgtgctcatgttgattgatgaccgctttgccgagccgcggattcagcagttgctgccgcgctggtggtcaatcaaaaacgaggcggacgcttttcaattcgccggattaacgcatactccagcacataactgtgtgcggtgaatgtgatgattgaaaagaacaagaccgcggcgatcgaggagatgcgtttcaggctgttgatcgatgcggtcgtcgactatgcgatctacatgatcgacccggatggcatcatcaccagctggaactcgggcgccaaacgcttcaagggttacgaagaggcggaaatcctcggcgagcatttttcgcgcttctatactgccgatgatcgcgctgccggtctgccgcgacgtgcgctcgataccgcgatccgcgaggggcgtttcgagggcgaaggctggcgggtgcgcaaggacggcaccaacttctggtcgcacgtggtgatcgacccgatcattgatcccgacggcaagttgctcggtttcgccaagatcacccgcgatctcaccgatcgcaagatggccgaagaaaccctcaagcaaagcgaacagcagttccgcctgctggtgcagggtgtcaccgactatgccatctacatgctcagccccgagggccgggtcagcaactggaaccagggcgcccagcgcatcaagggttatctgccggaagaaatcatcggtcagcacttctcgattttctatacccccgaagaccgcgaactcggcgagccgcagcgggcgctggaaatagccactcgtgaaggccgctttgagaacaagagctggcgcatgcgcaaggacggcacgcggtttctcgcccatgtggtggtcgatgcgattcgcggcgataccggcactttgctcgggtttgccaagatcacccgcgacatcaccgaagcgcatcaggcccagcaggcgctcgagaaaacccgtgaagccctgtttcaggcgcagaagatgcaggccatcggtcagctcagcggcggcatcgcccatgacttcaataatctgctgacagtgattctcggcaatctggaaatcgtgcaaaagcgcatcggtgacgacgcgaaaatcagccgcttgctggaaaacgccacccaaggcgcattacgtggcgtgtcgctgacccagcgcatgctggcttttgcccgccgtcaggagctcaagaccgagtccgtcgacatcccccaactggtgcaaggcattaccggactgttgcgcagttccctggggccgggcatccgcgtcgatgcgcggtttcccgagggtctgcaaccggtgctggcggacagcaatcaactggaactggccttgctcaatctggcgaccaacgcccgtgacgccatgcccgacggcggcacggtgatcatcagcgctgaagcacaagtggtgctcgaactcggtcatgcggatctgccggccgggcgttatgtctgtctcagtctgatcgacagcggggagggcatggatgcgcagacgctggcctcggccagagacccgtttttcaccacaaaaggcttgggcaaaggcacagggctggggctgtcgatggtgcacgggtatatggaacaactcggtggccgcttcgtcctcaaaagtgcaaaagcccagggcaccacggctgaattgtggattccggtggctgacgagggtgtctacagcaagccgctgtatccgccggcagagccgatcacggtgcccaggctcagcgtgttggtggtggatgacgattcgctggtgttgaccagcaccagcctgctgctcgaagacctggggcatcgagtgatcagcgccacgtcgggttcgcaggcactgacgctgttcgatcagggtgaggtcatcgacctgttgatcaccgacatggccatgccccatatgagcggtgcacaactggcccacgcggtgcgggtgctcaaaccggatctgccgatcattcttgccaccggctacgccgagcgcctggagggttttgccgcgcaactgccgcggttgcccaagccgttcacgcagatgaatctggtggcgatcattgcgcaatcgatgaagtgaggcgccggtcaatccggctgaacttgcgcgcaaacggggacttctaaacgttttcccaaccccggagcgtgcatcttttgtctcgcatactgactgagcccaccgctgaagaaaccctgaccgaacatgacgccaagatgttcggctcacccaaggaacggctggatttctatcggcgggagatccagtacgaaaccagcattcttgccaaccgcaccgatgcctatctggcggcgcagtcgttcctggtgatcgccttcgcctcctgcatggccaacctcaatccggagtggggcaagttgttcacgctggtggtgccaccgtttctggcgctgctcgggctgctcagttccttgaacgcctggccggggattcgcgcagcgtacgacatcatcgatcactggcatttcaagcagagccacttgctccacagcgagccgctgatgggcctggcgtatgacgaatcgccgttgttcagtgagatggaatcgagccacaagggttatcgcaagtcgctgctgttctcggtgcgcacgccttggatcttcgcgacgttctgggtgttgttggggagttatgcggtgtttattcaggtgaccaatcctggagggtgatgggcaggtatagaaaagcccggcttatgtggccgggctttttcattcgcttggattttgtgttgccattcagatcgatccccctcaccccagccctctcccccaagggggcgagggggaagggagcagatcttcgctgcagtcaaaatctgcgttcgactcggtatctcagtgtcgtggtcaaaatctgcgtgcaacccggtatctcaagtcggcgtacctcaaccattcacctcggtcagttccctctccctctgggagagggccagggtgaggggctttcagggttcatatcgcagagagccaatatttgcactgctcaaaatttgcgtgcaacccggtatctcaagtcggcgtatctcaaccattcaccccggtcagttccctctccctttgggagagggctagggtgaggggcttttccgcctcactccacggtctcaagctctcgacgcaacgccaccgagttctgcgaagacatcgggatcggcgggaaatcttcattcaagacgcacaaatgatcgatggcatcttcaaacatcgaatcggctttcttgcgcagcgcgcggtagcgctcgaactgttcgatgtccagatccttgacgtcaagcagcgcattggccgctcggttgagcgtgtgggcgttatcgaacaattgacgattgcgttccagagccagtgctctgcaagccttgatttgtgcaggagtcgagcattctttcatgttcgtgaccttattcttcaaggattccgtttcataggcgtatcgccgcaggggaaccgaacctgccgggccccgccggacacatctggcggggggttatgcttgtgactgtcggcgattaagcaaggatccatttttttacagaaaaaaattcgattaatccgtcgataaaatccgcgattaaaaatcacgttttttgtttcttgcgctgttcatagcgagcgaggatcggttgggtgctgatcccgtgaagcaggatgctcagcgcgaccaccgacaaggtcaggtcggtgcattgcgtggccaccgtgtcggtcagcccgtgattcaaggcataaaacagataaaacaggctgccgatcccgcgaatgccaaaccagccgatcaacagccgttgccgtccctccagcagcgcgccccatggcatcagcgcgacgcaggccgggcggatcaggcagaacaacacaccgcccaccagcaacgcccgccaatcccaatgcgccaccagcacgacgccgagcaaggtcaccagaaacacttccatggcgcgctcgaccagactgccaaatgacaacatgtcacccatcatgatccccgcggcaacctggctgctttccagccgttcggtgtcgccatgcaccgcgtgttgcggttcgacgttctgatggccgaccaccggttgcaccagatgctcggcaggcggctggccggcgccggtggattgcacttccacctgacgcaaacccagcccggcggcgaacaccgacaggaagccataaccgccaatcgcctcggcaaccacataggccagggcaatcaacgacaacgccagataatcattggggctgagggtgctgtcgtcattgcggattcgtagcgaaagcgtcacgcgcccgatacctcggcccatccagtaaccggtgagtaacccggccggcaccgcccacaacacactgcgcaagacccagccctgccattcgctggcgctgccatcaccgtgcagcaacaacaggccgagaatcacgaaggggaaggcgatgccgtcattcaatcctgcttcgcccgagagcccgaaacgcacgctgtcgacatcccgcgcatcgttgacctggacaagtgccgccagtaccgggtcggtcggtgccagaatcgcgccgatcaacagtgccggcccccacggcaagcgcaagccaaaatgcagcagcagacaaacaccgatgatggtcagcaacatgactggcccggccaggccaaaagcaatccgccaacgcttgtcgcgcaaaggcaagcgtaacttcaaaccgcagacaaacagggaaaacagcaccgcgacttccgtcaggtgctccatccacagcgaagcgttttccaacgacagtttcagcagatcgaggccgctggggccgatgccgatccccagcaacagacacactgccgaagtcgtcaccggcatccagcgcagatacgaagaagtcagtgccaacgtcagcagcacggcaccgagtacggcaacccacacagtaaaactcatgatttgccgccttcagtgattaatgacggccgcctgcagagaccctttcgctcctgacgccgcccctgtaggcgttgccgcaggctgcgatcttttgatcttgttttaaaaatcagaatcaacagaccgccgcctgcgcaaacccccgcagtgcatttactcaaagcatcggcttgccaccggtcacgccatagcgctggccggtgatataactcgcttcgtccgaggccagcagcacgtagatcggcgcgacttccacgggttgaccggggcggccgagcggggtgttgccaccaaagttctgtacttcttcatcgggcatggtcgagacgatcagcggcgtccagatcggccccggtgctacgcagttgacgcgaatttccttcggaccgagcatctgtgccagaccgccagtgaaattggcaatcgcgcctttggtggtggcataggcgagcagggtcggtttaggcatgtccgagttcaccgaactggtgttgatgatcgacgccccggcacgcatgtgtttgatcgctgcctgacacagccggaagatcgcggtgatgttgacgtcgaaggtcatcacccattcttcgtcagggatttcttcgaaggtttcgtgggtcatctgaaacgcggcgttattgaccagcacgtcgatgcggccgaagcgttcgacggttttgtcgaccaaggcctgacaatgggccttttgtgcgatatcgcccggcagcagcaggcattgacgcccggcctgttcgacccagcgcgcggtttccttggcgtcttcgtgttcgttcaaataggcgaccgccacgtcggcgccttcacgggcgaaagcaatggccacggcgcggccgatgccgctgtcggcgccggtgatcagggcgatcttgccggccagtcgcccggaaccgacatagctttgctcgccgcaatcgggatagggttccattttgcgttgcgaaccgggaacggtctgggcctgtgcggggaagggtggttttggatagtcggtcatcgcgggtctccgaggtctcagggctggtatgggcggttgacccggtgtgtttgccgtgagttcgatcggatttacgccgaagattttgcgtgaacacacatcccctgtaggagtgagcctgctcgcgatagcggtatttcagtcaacaatgatgttggattttagaacgctatcgcgagcaggctcactcctacagggggatgtggtgttttcaggtgttgcgctgagtcagggcgcgctccatgcgggcaatgccttcttcgagcaacgagcgtgggcagccgaagttcaggcgcacgaactgctggtgttgatcgccgaagtccagaccggcgctgaggccaaccttgccctgctcaaggaagaactgctgcggattgtccagatccagcgccgagcaatccagccacgccagatacgtgccctgtggcacattgatggtcacgcccggcaagcggctgcgcaccgcttccaccagccagtcgcggttggcctgcagataggttttcaactcggccagccacggcgcgccttcgctataagccacgcgggtggcttccatgcccagcgggttgacgctgtcgaccatgccgcagcgggcgtggttgacgcgctcacgcagggccgcatcttgaatgatcatgaacgaggtcttcaggccggcgatgttgtaggccttgctcgccgacatcagggtgatcgtgcgcttggcaatctccgcgctcaacgaggcggtcggaatgtgcacgcgaccgtcgaagcacagttcggcgtggatttcgtcggagatgatccaggcgtcctgcgccgcacagatatccgccaccgcttgcaactcttcacggccaaacactttgcccagtggattgtgcgggttgctcagcaacagcgcgccgccaccgttcagcgattcacgcaacacgtccagcggcgtcaggtaagtgccgtcagcttgcgcgaggaactccagctcaaccttgttcaaaccccagtggcccggcgcgtggcgcagtggcgggtagttcggcacttgcaccacgacattctgctgcggctgtaccagcgctttcagagccatgttgaaaccggactcgacgcccggcaggaagatcagctcttgcggttttaccttccacgcgaacttggcccagaggtcggcgacgatggcttcacgcaggttgtcctgcgccacgctgtagcccaccagcggatgcagcaagcgctgttgcaaagcctcgatgatgaccggcggcgcggcgaaatccatatcagcgacccacatcggcaagacgtcggccgaatagcggctccacttggtgctgccagtgttgtggcggtcgaatagctgatcaaaatcgaaagtcatgcgcggtctcgtgaaggcgggattggtcctgcgggcatgataaacctacaacccctgtaggagctgccgaaggctgcgatcttttgattttgtttttaaagagcaacatcaaaagatcgcagccttcggcagctcctgcacagatttgtgtattgcctgacaaacggccgacggtcggttttcacacagatcgtgtggtcattgtctacagtgaaaaggtcggcagacgtttgccgcaaccgtgattgtccagataaaacccggcaccagtaccgggttccacctgatcaggagtgcacgatggatctcagccgtcgtcagttcttcaaggtcgccggtatcggccttgcaggctcgagcctgggcgcgttgggcatggccccgacgccagccttcgccgagcaggtgcgccacttcaagcttgcccacacccatgaaacccgcaacacctgcccgtattgctcggtcggttgcgggttgatcatgtacagccagggcgatactgcgaagaacgtcgcgcaaagcatcatccacatcgagggcgacgccgaccacccggtcaaccgcggcaccctctgcccgaaaggcgcaggcctgcttgacttcattcacagtcccggccgtttgctctacccgcaaacacgcaagccgggcagcagtgaatggacgcggatcagttgggacgaagcgctcgaccgcatcgccgacctgatgaaaaccgaccgtgacgccaacttcatcgaaaaaaatgccaacgggcaaacggtgaatcgctggctgagcaccgggttcctcgccgcgtcggcagcgtccaacgaagccggttacatcacccagaaggtgattcgcagtctcggcatgctggggttcgataaccaggcgcgtgtctgacacggcccgacggtggcaagtcttgccccgacgtacggccgtggagccatgaccaatacctggaccgatatcgccaacgcgaatctgatcctggtgatgggtggcaacgccgcagaagcgcatccgtgcggcttcaaatgggtgaccgaggccaaggcgcacaacgctgcgcggctgatcgtcgtcgatccgcgttttacccggaccgcttcggtggccgactactacgcgccgatccgcaccggcaccgacatcgccttcatgggcggcctgatcaattacctgctgaccgaggacaagatccagcacgagtacgtgcgcaattacaccgatatgtcgttcatcgtcagagcaggctacggcttcgaagacggcattttcagtggctacgacgcggagaaacgcagctataccgacaagtccggctggggttacgagatgggcgacgacggctttgtcaaagtcgacccgacactgcaagacccgcgctgcgtctatcaattgatgaagcagcattacagccgctacaacatcgacctcgccagccagatttgcgggatgccggtcgacgccatgcagaaaatctgggacgaaatcgccacctgctcgatcccgggcaagaccatgacgattctttacgccctcggctggacccagcactcgatcggcgcgcagatcatccgcagcgcggcgatggtgcaactgttgctgggcaacgtcggcatgcccggcggcggggtcaacgccttgcgcggtcactccaatattcaggggctgaccgacctaggcttgctctccaacgcactgccgggctatctgaccttgggtcaggacagcgagcaggactacaacgccttcatccacaaacgtacgcaagtgccgctgcgtccgggacaactgtcgtactggcagaactacagcaaattccacgtcagcctgatgaagtcgtggtacggcgctaacgccacggtcgagaacaattggtgctacgaccatttgccgaaactcgacattcccaactacgacgttctgaagatgttcgacttgatgagccagggcaaggtcaacggctacttctgccaaggcttcaacccgatcgctgcgctgccggacaaaaaccgcgtaatgggcgcactggccaagctgaaatggctggtggtgatggatccgctggccaccgaaacctcggagttctggcacaacgtcggcccgtacaacgatgtgaaaaccgacgaaatccagaccgaagtcattcgcctgccgaccacttgttttgccgaagaggacggctcactggtcaacagcagccgctggctgcaatggcactggaaaggcgccgacggtccgggcgaagcgcaaaccgacatccgcatcatgagtgaattgttcctgcgcctgcgcaagcgctatcaggccgagggcggcaaattccccgatccgctgctgaaactgacgtggccgtacaagatcgccgacgaaccttcgccggaggaattggccaaggaaatcaacggcagcgccgtggctgatttcaccgatgccaccggtgtcgcggtgaaggccggttcgcaactggcggggttcggcttgctcaaggatgacggcagcaccgcgtccggctgctggatcttcgccggcagttggaccgaggcaggcaaccagatggcgcggcgtgacaacagcgatccgttcggcatgcaccagcatctcggctgggcctgggcctggccagccaaccggcggattctctacaaccgtgcttcggcggacgtcgccggcaaaccgtgggacccgaaaaaacgcctggtgtggtggaatggcaaggcctggaccggcaccgacgtaccggactacaaggctgatgtgccaccggaagccgggatgaacccgttcatcatgaaccccgaaggcgtggcgcggttcttcgccgtcgacaagatgaatgaaggcccattccccgagcactacgagccgttcgaaacaccgatcggcatcaacccgctgcacccgcaaaacaagaaagccaccagcaacccggcggcacggatcttcgattcggtctgggaaaccctcggcgaggccaaggacttcccgtacgccggcaccagttaccggctcaccgagcatttccacttctggagcaagcattgcaagttgaacgcaattgcccaacccgagcagttcgtcgaaatcggcgaagtgctggcgaaagagaagggcattgctgccggagatcgggtgcgcgtcagttgcaaacgcgggtttatcgaggcggtggcggtggtgacaaaaaggatccggccgctgcaggtcaacggccaggtcgtgcatcagatcggcatcccgctgcattggggtttcaccggcctgacgcgtcacggttacctgaccaacaccctggtgccgttcctcggcgatggcaatacacagaccccggaatccaagtcattcctggtcaacgtggagaaactgtaaatggccagccaagacataattgcccgctcggccaccaccacggtgccgccatcggtgaggaatcaggaagcggtggccaagctgatcgacaccaccaaatgcatcggttgcaaggcctgccaagttgcctgctcggaatggaacgagttgcgcgacgaggtcggccacaaccacggcacctacgacaacccgcaagacctcagcgcggaaacctggacgttgatgcgtttcaccgaacacgaaaccgacgccggcaacctcgagtggctgatccgcaaggacggctgcatgcactgcgccgagcccggttgtctggcggcgtgcccgagccccggcgcgatcatcaaacacgccaacggcatcgtcgatttcgatcaggatcactgcatcggttgcggctattgcatcaccggttgcccgttcaacattccgcgcatttcgcagaaagatcacaaggcctacaaatgcaccttgtgttcggaccgcgtggcggtggggctggaaccggcctgcgtgaaaacctgcccgacgggtgccatcgtcttcggcaccaaggaagacatgaaggaacacgccgccgaacgcatcgtcgacctgaaaagccgtggcttcgaaaacgccggtctgtatgaccccgcaggtgttggcggcacgcacgtgatgtacgtgttgcaccacgctgacacgccgaccatttacgccaatctgccgcaggatccggcgatcagtccgttggtggggttgtggaaaggcatcagcaaacctctgggcctgttggccatgggcgcggcggtgttggccgggtttttccactacgtgcgcatcggcccgaaccgcgtagaagaggatgaacatccaacgccagccgacacctcggtgcacgtcgttgatccggcggtacacaccttcgatccacgcggggaggaccggccatgagcaacaagacgatcctgcgttataccgccaaccagcgtaccaatcactggctggtggcgatcctgtttttcatggccgggctgtccgggctggcgttgtttcatccgtcgctgttctggttgagcaacctgtttggcggcgggccgtggacgcgaattctgcatccgtacatgggaatagcgatgttcgtgtttttcctcggtctggtgctgagtttctggcgcgccaacttcttcatcagcaacgacggcaagtggatgcgccgcatcgatcgggtgttggtcaacgacgaagaaagcgtgccgccggtgggcaagtacaacgccgggcaaaagctgttgttctggactttactgctgtgcatgctcgggttgctgttcaccgggctggtgatctggcgcgcctggttcagtgcgtacttcggcatcaccgtgattcgctgggcgatgctgttgcacgcgctggccggtttcattctggtgctgagcatcatcattcacatctacgcggggctgtggatcaagggttcggtggatgcgatgctgcatggctgggtcagccgcgcctgggcgaagaaacaccatgaactctggtatcgcgagatcacccgcgatgaacgccatccggacgtgccggagcgaccgatcaccaaaaagggctgacttttgccaaccattctggaacctggggaaatcgaagcggcggcgagttcgccgccgtttctgcatctgccgccgcttaacctgtttaccttgcgcgcgcaacggctggagcaactggccgaggggcatgcgctggccgagtatctgcgcttgatcgccggattgtgccgggtgcagcagcaggtgttcgatgatccaccactggtggcgccgttcgatcagcaacggatcgaagcgtgtctgcagcatggtttgccgccgttcgcggcggatacgttggtgcgcgaagagggctggcaagcttatctcggcgctgttctgcagcgttaccagcctttgggtcaacccgctgtcgttgcagcggtggacacgctgcgcgccgccagttccggccagttacgttcgtgggcggtggcgttggtcagcggtcaatattcgatggtgccggcgcaactggtgccgtttctcggcgcggcattgcaaacggcgtggagccattggctgctcagtgcgccggatctgaaactcagacccggcgacagcctcagccaatgcccggcctgcggttcaccggcgatggccggggtgatccgccatcgcggcaagcacaacggtttgcgttatctggtgtgttcgctgtgtgcttgcgaatggcatgtggtgcgggtcaagtgcgtgtattgcgagtcgagcaaaggtctggattatctgagtgtcgaggacgatcgtcacgcggcgaatcaggcgccgttgcgcgcggaggtttgtcccggctgcaacagttatctgaaactggtgtatctggaaaacgatgccgacgccgaggcattgtcagcggatctgagcagtttgctgctcgatatgcgtttggctcaggatggttttcagcggctggcaccgaatctgttgctggctccgggagacgaatgaccggcagcgtctacactcttgggcgatagcggttgtctccaggagtgactgatgtccctgcggttaccttccattgatggtctgttgcgtcatccggcatgtgcgcatttgctcgaacgtcacgggcgtgagtcgctgctggcgagtttgcggtggttgctcgatgaattgcggcccggcgtggtgaacgggcacttgtctgcgatagaaatcagtcccgaagtgttggccgggcgcgtcggcgaacgcttggcgcagcaacaacgcagcaacgttcggcgggtgttcaatctcaccggcaccgtgctgcacaccaatcttggccgcgctttgttgcccgatgaagccatcgacgccgtgcaaatggccgcgcgttatccgctcaatctggagttcgatctggccatcggcaaacgcggggatcgcgacgatctgatcgaaggtctgatccgcgaactgaccggcgccgaagccgtcaccgtggtcaacaacaatgccgccgccgtgctgctgacgctcaacagtctgggcgcgcgcaaggaaggcatcatttcccggggcgaactcatcgagatcggcggcgccttccgcatccccgacatcatggcccgcgctggcgtgcgtctgcatgaagtcggcaccaccaatcgcacccacgcccgcgactatgaagcggcgatcagcccgcgcagcggtttgatcatgcgcgtgcacgcgagcaactacagcatcgaaggcttcaccgcccgcgtaccgactgcggaactggccgagttggcccatcgacatggtttgccgttgctggaggatctgggcagcggcagtctgctcgacctgactcgttggggcttgccggcagaaccgacggtgcgtcaggcgctgttcgatggcgcggacatcgtcaccttcagcggcgacaaattgctcggtggcccccaggccgggttgatcgtcgggcgcaaagagctgatcgcgaagatcaagaagaacccactgaaacgtgcactgcgcgtggacaaactgaccttggcggcgctggaagcggtgctcggtttgtatcgtgatccggatcgtctcgctgagcgcttaccgagtttgcgcctgctgacgcgcccgcaagctgacatcttcgcgcaggccctacgcttgcggcccttgatgactgagttgttgggtgagcgctggcaggtcagtgcggtcgaagccttgggcatgatcggcagcggcagccaaccggtggcgcgactgccgagtgcggcgttgtgctgtcgcccgcaagtgtcaaagcgactgcgcgggcgttgtctgttgaatctcgaagcggcgttgcgcgggttgccgatccctgtgctcggtcgtattgacgacgacgcgctgtggctcgatttgcgccaactcgatgatgagccggcgtggctcgcgcaattgccgcacctgcaggtcgccccgtgatcatcggcacggcggggcacatcgaccatggcaagacgtcgctgctgcaagccctgaccgggcaaaccggcgaccgtcgcccgcaggaacgcgagcgcgggatgaccatcgacctcggttatctatatgccgaacttgagccgggcgccggactgagcggatttatcgatgtgccgggccacgagaaattcactcacaacatgcttgccggagcgcaaggcatcgatctggtgttgctggtagtcgcagcggatgacggcgtgatgccgcagacgcgggagcatctggcgattgtcgaattgcttggcattccgcgcgccgtggtggcgatcaccaagtgcgaccgcgccgaagcgggcagggtggaagaggtgcagcgacaagtgctcgacctgctcgccccggggccgtttgccgaggcgccgatcctgaccgtgtcgagtctgagcgggcagggcattgatgggttacgcgaggtgctgctgcagacgcaacgtgaagtgctggaacgcaaccgcgacggcggttttcgtttggcgattgatcgggccttcagcgtttccggcgcgggcattgtggtcaccggaacggcgttgtccggggtggtttctgttggcgacaaactcaccctcgggccttccggaaaatcggtccgggttcgcggcttgcacgcgcagaatcaacccgccgaacaggccttcgctggacaacgagtggcgttgaatatcagcggcgaacgccttgaactggcgcagattcatcgtggccagtggttgctggcggaatggctaaatgcaccgactcagcgcgttgacattgaatttcgactgttgcccggcgaacgcaccttcgaacactttcacccggtgcatgtgcaccttggcacacaggatgtgattgcccgcgtcgcgttgctcgaaggcccacgtttgagcgccggtgaacgcatgttcgcgcaattgctgatcaacgcgccggtgcacgcggtgaagggcgatcgcctgatcctgcgcgactccagcgcccaacgtactctcggcggcgggcgcgtactcgatcccttcgccccggcgcgccaacgccgcagccccgagcgtctggcgcaactgcacgcgttactgagcagcgacagcctcgagcaagccttgcccgtgctgttaaatcacagcgccggcggcctcgacccgctgcggctggaacgccaattcaatcgcccgcgctcgagctggtcactgccggaaaacctaaggttgatcgaaacccgtcagggccccgtgctgttcaacctgcagcgctggggccagctgaaattcaacttgctggagcaactggcgaagtttcatgaactggagcccgaccagatgggcccggatcgtgatcgactgcggcgcttcagcgcactggcgctggagcggtcgacatttgccagtctgctcgatgaactacgcgaagcgggtgtgatcaccagcactggcccgtggctgcatctgcccgatcatcaggtgcgcctgaataccgaagacgaaagcctgtggctacagatgcagccgttgtttgaaaacgcaggattcgatccgccgtgggtacgcgatgtggcgaaaatgctcggtcaggacgatgccgtggtgcgcctgctgttgcgcaaattggcgcggctgggattgatgcaccaggttgtgcgcgacctgtttgtcagcgacacggtgttgcggcagatggccgccgtcttgttgaaactggccaaggaaaatccgtcgatccaggtgacaaccttccgcgatgcgctaggcttgggacgcaaacgctgtattcagtacctcgaatacttcgaccgcctcggtctgacccgacgcctcggcgagtcccgccagatccgccccgacaacgcgctggctaacgcctgcgcacactgagttcaaggaaggcaatcgcgcccggtggcgcggccgggcttcaaacccggttggggacggcatccgttcccgggcaggttcgactccggctgccttccgccaattaccaaaaagccaaagaacggctgccgttgattgatcgttcccacgctccgcgtgggaatgcagcccgggacgctctgcgtctcatccagagccgaacgcggagcgtccgttgaggcattcccacgcagagcgtgggaacgatcaaagaacctgtgggagcgagcttgctcacgatggcggctttgcagatcgattagatttagcgggagtaaaaagggggcgaattagagatttcgctgcgcttccattcggtcatgcaagactctgatgatcgcaatcccgtaagcagtgattcggaaataaatcatgtgccgctccacgcgacaacggcggtagcctgcacgtatatcgtcgcaggctggcgccgtttttggccgctcggccaactgcaagaacgcagagatgagtgcgtcgatgtaattattgccttgatccacgccccactggcgtgcggtgtatatccagattgcctccaggtcagcttcggcagcgggcgtaagacgatattcagtcatgcttggttaacattctccgcttgaatgcaacgggatcgaatgggcgaggttttccactggactcaccctcgcgaagagctgcgcgaattgtgtcgatctcagcgctacgctcctgctcacggcggataagatcgcggatgtattcgctatcgttggtgtaatgccccgcctcaatctgcgctttgatccagttgtcttgctggtcggtgacggtgatggttttgcgtacggttcccatgatttgggcctccagacagatgggcgactgcgtgcaaattatcatactattggtgcgctatcgagcactcaggcctgtcggtcaagctatccaaatcgcgcaggaatgttagggttttgggtgccgaattacataaacgcttctgttcaagatgttaatgaacgagcggattcaaaaccccaacgggtactgcaccaccacataaacccggtcaatatcatccccagcctgcgcctcattggccctatgcgaaacgtgcgatagctgcaccgacaaatccttcgccgcgcccgattgcacgatgtatttcagatcaatatcccgctcccaatgcttgccaccatcaccttgctgtggctgatattcgccgctgtcggcatcgaatgggttgtaggcgccgccctgtggcgcgtgggtgccgtcgatgtggctgccggtgacgtagcgggtcatgaaagtcaggccggggatgccgaaggcgccgaggtcgaagtcgtagcgcgcttgccaggagcgttcgccggcgccgttgaagtcggcgtatttgatcgagttggcgaggtagatcgagtctccgccgacgaaatcgaacggtgtgtcgccattgacccgttgccatccgagcatcacgccgtgcgcaccgtaagtgtattttccggagaggctgaacgccgtgttgtcgatggcgccggccaaggctcgaccggtgtcgcgggtgcggtagaggttggcgtccagcagaaccccggactgcttgaaatgcagattgccgtagtactggtgccaggtgtcgctgagttccgaggcatacagcgaaccgccgacggggctgtcgccgaacagatccgcgccgaggaagctgatcccgccggcttcggtgttggcgccgtagccatagaagtcgccacgaccggaggaactgtcctggttcttgaaggtggtgaagtgcccggcgacgagattcacgttgtcgatttcacggctgtttaatagaaacccggtggcgtattccggttgcaaacgtttgtcggaggtgtcgaaaactggcgtttccacggtcatttcgccgaacgccagggtagtgcgcgacaccttcagtttgaacgcgccgcctgcgtcggagtaattcgattcgctgcgaccgctgctgtcgaccggtagcaagccggtgccggaatgtcctttgccgccatccagtttcagaccgagaaaagcgtgagcatcgacgccgaaaccgacactgcctggcgtgaagcccgaggtgaaggtgccaatgaagccttgcgcccattcctgtttgtagtttttgccggtgggcgagggtgagcgatagtcgttgctcaggaagaaattgcggctgagcacttcggttttcgaatcgtcgagaaaaccgctggcactggcggttgcctgcagaccgcagagcaaagtgagcaggctgagacgcaaaggggcatggtcgatcatggtcagtggccagcaattgaattggctgaatgatcgagggatatccgctgacaagattgagccgatgtgctgaattgcactaacgccatcgccagcagggctggctcccacagggttttgtgtcggtcacaaaattcagtgggtaacccaaatcattatgggagctggcttgccagcgatggcggtgggtcagtcaatggaggtgttgactgtgctgcctcatcgctggcaagccagctcccacagggttttgtgttgaccactaaattcatgtgcagcactgatcattgtgggagctggcttgccagcgatggcggtgggtcattcaacatccatgtcacagaaccaccgctttcgccagcaggctcccacaggagatggagggtggtttacaggacgccgtactcccgggcggtacggtccacagcgatgcgggtcttgtcgatcagttcgtccagctcggcgcgggtggcgatcaatgccggggccatgatcattcggcccagcgtcgagcgaataatcaaaccttcttcaaaaccaatcgtgcggcaacgccaggcgatgtcgttctcgttggcaaaacgcttgcgcgtcgccttgtcttgcgcaaactgcaacgccgccaccagccccacgccctgaatctcgcccaccaacggatggttgccgaatacttcgcgcaggcagttttgcagatacgggccggtatcgttcttcacctgagtgaccacaccttcatcgcgcaacgccttgaggttggcaatggccaccgcagcggcaaccggatggccggagtaggtgaggccgtgagcaaacacgccacctttctcgaccaacgcttcagccatgcgccgcgacagaatcaaaccgcccatggggatgtagccggaggtcaggcccttggcgatcgacaaggtgtccggttcaaaaccgaaggcctgatgggcaaaccattcgccggtgcggccaaacccgccaatcacttcgtccgcgcacagcaacacatcatatttgcggcagatccgctgaatctccggccagtaagtcgccggcggaatgatcatgccgcccgcgccctggaacggttcggcaacaaacgcggcgaccttgtcggcacccagttcgagaatcttgtcctccagttgctgcgcagccttcaggccgaattgctccggtgtcagatcgccttcgtgggcaaaccaatacggctcatcaatgtgcgcaacatccgggatggtgccgcccatctcatgcatgaacttcatgccgcccagcgccgtcgcggcgagggtcgagccgtggtagccgttccagcggccgatcatgattttcttctcgggctgacccatcacttgccagaacttgcgcacggtgcggatcagcacttcgttggcttcggagccggagttggtgtagatcgcgtggctgtagtgcgtgggcagcaggctgaagagcagctccgacagctcgatcaccgccgggtgggtggtatggaagaacatgttgtagtagggcagttgttccagttgtttcgtcgccgctgcggccagatccttgcgtccgtatccgagattggtgcaccacagaccggacatgccatccagataacgattgccgtcgttgtcccacagcgccaggcgatcaccgctgaccatcacccgcgggccttcctcgttgagggctttctgatcgacgaacgcatggatgtggtgggcggcgtcggcatcctgataatcacgggtactgcgggtcggatcgaattcggcggacatggctgatctccagaaatgggcgagtgagtgcgttcataccagcggagcacggctaatatttgtcactttaaaatatttttgtaaagaaaatatttgtcgatgaaaaaagatatccgtaggctgagcagcattggcaaggatcatcagaggcaacatgagcggactcagagagcggcaaaaggaacagcgcaggcaagtgatcgccgaggcggcgcttgcactgttcaagaccaacggatttgccgcgacgacgctggatcagatcgccgtgcaggccggggtgtccgcgccgacggtggtgaattatttcggcggcaagcaggaaattttgctcgcgttgctcaaacaacccgacgaacaggccatgcgcgaggcgcgggcaaatctggacgatgacagcgatccgcttgaagcactgtgcaagttcgagcagttgatgacggattaccagttgcaagccatgccagcctcgctatggcgggaactggcgccgtttctgctcaccggcgaattggccgaggcgttgagcccgtggaatgcagcagtgattgaagagacgaaagcgctggtggagcactttcaacgggcagggaaggtgcgcgagtcgattgatctcgatgtggtcgcaacgctgttcaatcaatacgcgaacatggcgttcattcgactggcaacccaggaaactccggacagagccgcgcatgcgttgcacatgcgcggcgtccttaacctgttatgtcacggcatgctggtgagttgaacacgggcaaaatctttaaaaccgccatgtgacgccgccgccaacaatgtgcaacgcactgttgggatagctgcccgacagcgtctgtccattgcgtttggtctgctgcacgtccatatcgccgagccagaccagcgtgtaattaaggttaaggtcggtgtcttcggccagtttgtagctcagcccggtcgccagccgccaggtctcgttcatcgggttgtcgacggtgcgatccttgtccttcacggcagaactgtcgtagcccacgcccatgttccagcgcagtttcgggctgatctggttttgcgctccgatcgacaggtgccaggtgtcctggtatttgcggtcgaccgcgcgggacacgtcaccggctgcgctatccaccgatacgccgatgtcggcaaattcgctccagtcctgccagttcaccgagctcaacaacgtccactgctcgttcaactgatgggcgatgctcagggtcgcggtctgcggaatgttcatgtcgatttcgagttcgtcgacgtcaagcctcgataacgccagattgagcagtgggttgcgcacgccatgcactgaaggcgagtccttgaactcaagcttgaccttgctggtgtaagccagacccacggtggtgcgctcgttcacctgatagcgcaggcccaggttgatcccggtgccgatgtcggtgtctttgtactgcaacttgccatcctcatggaacggcgtgccgggcaggaaggcgttattgtcgatggccatttttgtgtagtagtagccatagaccaggcgcgggccgatgcccatcgacaagtcgtcggtgatcttgtaggcgaaggtcggctgcattgaaatgccgatcagcgtcgattcctggctgaaatagcggccggcccagtcatcgtcgtatttcacgctcagaccgaagttgccatacatgccgaagccgatactggcgcggtcgttgagctcatggctgataaacagactggtgcccggcaggatcggcagcggattgccgccctcgttgccggagaaatcgttgtcgccgtcgcgatcaaagcccagaccaccgaatatggcctgaccggtcaacgaaatctgcgtgcccttgagtgcggcgatacccgccgggttgctcatcagcacgctgggatcggtggccagcgccgccgatccggcattggccagccccgcgccttcctgtcccgcttcatacagatcaataccacctgccaacgcaggaccggatgagcccgccagcgcgagaataatcagggaatgcgtagatttcatcccggcgtccttatcaatgaagatcagccttcaggtttagtcgcgaattggccagagcaccagtcgagacgatttgcccgttgtgaactaggctcaggtcggttcaacgctggcccaatcaggagagccgaaatggaagacaaaccgctgatagcgttccagagttccagagcactgctggatgtgctcatacgtgccggtctgattaccgtgctggtgctgttctgtttcgacatcttccatccgttcctcaatgtgatgctgtgggcgctgatcctggccatcaccttgtatccgctgaatcagaagctcggcgccaggctcggtaaccgctacggctgggccgccatcgtactggtgctgctcgggctgttgattctgatggtgccgctgagtctgctcggcgcttccgtggctgactcggtgaaagtcggcatgcacacgctagaggcgggttcgttcgaaattccgccaccaccggccagcgtcgagacctggccgctgatcggtgcgccgctcttcggcatctggcagcacgcttcgcaggatctgagctgggctttcaaggagctggcgccgcacctgagcagttggggcaaagtgctgctgcatcaggccgccggtgtcggcgcaggcatcgtggtgtttgtcgtcgcgatgattgtcgcggggctgatcatgacccacggcgaaagcggtcaccgcaccgccgtcgccatcaccacgcggatctccggcccggtgcgcggcccgcagatcgccgaactgtgcacctcgaccattcgcgccgtggcacaaggggtggtgggtattgctttcattcagatgctgttgatcggcgtggcgctggtgatcatgggcattccggccgccggcattctggccctgatggtgttgctgctaggcatcatgcaactgccggtgctgctgatcaccataccagtggtgatttatgtctttgcccacgacggcgtcagtgccggcaccgtcatctttacggtgtggatgatcgttgccgggctttccgacaacgtgctcaaaccgatgttgctggggcgcggcgtggcggtgccgatgccggtggtgctgatcggcgctttgggcgggatggtcaccagtggcatcattggcctcttcaccgggccggtgattctggcggtcggctatgaattgttcatcggctgggtgtatcaacccgccgatgtcagccgtgttgtcgaagacagcccaacggaaaatctgccgtgacacttattgaatcgaggaaatctgacaaccgttcatcgctcaactacgctggcttacgtatccctatctgacacttgggcgtaaggaaacaggcgcatgcgaagcaggctgctgacggtttggatagtagtgtttgcggcgctctggagtggactcggctgggcggtcgatgacgcggccaaaccggccggcgaggcggttgagctgaaggtggccaaccgcagcatcatgttgtttcgcgcaaccattctgggggaagcaccggcctcgcgggtcaaacgggcgaagatggtgatcagcgaggcgctggacgaaaacccgacgctgaacatcaccaccgactcgatccagaacagttacatggtgctgatcggtgacaagcgggcctttatcgttgcgccgcaggatgtcgacagcctggcctattcgtcggtgcaacaggccgccgaaggcgcagcggaaaaactgcgtcaggtggtcactgaaacccgtgaagcgcgcaacctgcagatgatcctgcgctcactggggctggccgccgtggccacgctgatttatgttgcattgctgtggtgcctggcgtatctgcgccgcaagctgctggcaaaactccccgcgctgatggatcgccacacccgggcgctgaaagtcggacgggtgcaactgatcgattccaacttcctctatcccttggtcagccgtttgctcttgctgctgcgctggctgctgattttgctgttgacctatgaatggctgggtttcgtcctgtcacgcttcccctatacccggccatggggcgaaagccttaacaactacctgttcgagctggcggggtatttgttgcaaggtattgttgatgcgattcccggattgggcgtggcgctggcgattttcttcattgcacgtggcgtgactgcgtttacccgacgcatcctgcggcgcatggccatgcccggcaccttcagttggctcaaccacgaaaccctgcaaccgactcagcgcctgacggctttggcaatctggctgttcgccctggcaatggcttatccatatctgcccggcgccggcaccgatgccttcaaggggctgtcggtgttgatcggcctgatgatttccttgggcgcgaccagtgtcgtcgggcaggccgctgccggtctgatcctgacctacacacgcaccttgcgtcccggcgaattcgtcaggattggcgactacgaaggcaccgtcaccgaactgggcatgttcaccacacgcatccgcacggggctgggtgaagtgctgacgctgcccaactcgatgatcaccggcaccgtcaccaaaaactattctcgcaccgtgcagggccccggttatgtcgtcgatacggtggtgaccatcggctacgacacaccgtggcgtcaggtcgaggcgatgctgctggaagcggccaagcgcacccccggcgtgctggaagatccaccggcgcaggtgttccagaccgcgctggcggatttctatcccgaataccgcctggtcgcgcaggccatcccgagccagccacgtccgcgcgcggtgttgctgagcatgctccacgccaatattcaggacgtgttcaacgagtacggcgtgcagatcatgtcgccgcactatctgggcgacccgcaacaagacaagtgggtgccaagggacaagtggtacaccgcgccggctcaagaaccgaaggatcagtgatcgctgctcaagggagttcgccccatgctcgaatttatccttcacgccttgcgcaccgacccggaaatcgccgtgtttctggcgattgccctcggcgtgtttatcggccggattcgtatcggcagttttcacctcggctcggtggccggtgcactgctgatgggcttgctgatcggtcagatcggtctggaagtgccggcgggcctgaagtcagtgtttttcgttatgttcatctacgcggtcggcttcaaaagcgggccggagtttttcggcagcctcaatcgcggcacgctgaaactggtgctgctatcggtggtgctgtgcgtcacggcgttgggggcgattctgttgatgtactcggtgttcgatttcgacgccgggttcaccgctggcctcggcgccggagcgttgaccgatacggcgatcatgggcaccgcgaccagtgcgatcaatcaactgacgatcgacgcggccgccaaggcgcagctcaacagccacatggcaattgcctatgcgatcacctacctgttcggcacgattggcttgattgtcttcgtcggcagcatcgcgccgaaacttctcggcgtgaacctgcgcgaatcggcgcgggaactggagctggaactgggtatcgccaaggaagaagaggcgatcaccgtgccctatacgcgcatggtggtgcgcgcgcatcaggtcgcggaaaacggccaggccgccgggttgcgcatcatcgatctggaaaaaccgcacgaatcgctgaccgtcgagcgggtgatgcgcgccggcaaagtcatcgagcgcgatgaagagttcgtgctcatggcgggcgacgtcatcggcgtctacgccttgcgcgatgcagtgggcaacctcagtcactgggtcggcccggagatcgatcatcccgaagcgctgtcgtttccgacccgtcaggtagacatcgtcctgacctcggcggagttcgctggcaaaaccatccatcaagccaaatcgcgcctggccagcgaccggcgcctgggatgcttcgtcaacaacatcagccgtcagggctacgacttgccgttgctgcccaacaccgtgctgcggcgcggcgatgtgatctctctgaccgggcgcaccgccagtgtcgaagccatggccaaatgcttgggccgcatccgcaagaacaactacaaaagcgatatcgccatgcacaccctcggcatggtgcttggctcgctgttgggattgttgtcgacccatatcggcatgatcccggtggagcttggcatcggcggcggggtgctggtcgccgcattagtgattgggtggtacaactcgcgccacccggaaatcggcgcgttgccgccagcggcgcaatgggcgttttccgagttcggcttgaccgcgtttggcgcggtggtgggcttgctcgccgggccggcggcgtttgccgcgatgaaagagcagggcttggcgttgttggtgtctggcgcagtggtgaccattctgccgccgctggtggcgctgtatttcgggcgctacgtgctgcgcctgcacccgatgattctgtttggcgcactggctggggcacaaaccgaagcggcctcaatgaacaagatcatcgaacagtccggcagcaacacaccggtgattggcttcacggtgtgctacgcgatttccaatgtgctgctggcggtgtgcgggccgatcatcgtctttgtcgccgctggctgaaagcacaaatcagaagccactttcgcgcatcaacaccgccaacacatgggtcgcaccgtcgcccagcaagctgcgccgttcgccctcgatcttcagatgcccgcgagtctcgcgcaggctcggcagcggttcatccagctgaatcaacacctgaaacagcgcgctgctgggaatcagtgtgtgttcggcattggtcgtcggcaccgggccgccgaagcgtgaagacagcatgcgatgcgacaactgattggcgcgggtgctgccgatctgcacgacacgaccggatcgcggcgtggtctggccgtccgggtagaagcgtacgtggtcaccggtggccatgcggtgcacctgatcctgcgcaacatacgcgtcgacctgccagctgcgcggatcgatcagcatgcccagcgactcctgccgaccgacccattgcccgggtttccagtccggattgacgtccagccacaccccggcgaacggcgtttgcaggttcaaccgggcgatttccgagcgggcggcgcgggcctcttcgaattgcacgttgaggcgctggcgggtcaccgcgtcttcggccaagccgccggggtcggcgatcagcccggacagccgcgcctcgtagctgcgggcactggcttcgctggtttgcaggcgcgaagcgatgtccggttcatcgagggtaatcagggtttctccggccttgaccgggccctccgagtgaatcgattgcaggcgcgccgggtagggcgcatacacccgcaactggtgctccgcacgggccacgccaaccgcgtcgatctgcgtgcgccacgggatcgccaagcccaccagaatcgccagcagcacggtataaaacgccactttgcgccggcttggaatcgccgcgcggtttttccaccagtgacccagttcgcgcattaccggcatcgcgataaaccacgacagttcgaccatgaacaggaaaatccccaagaccttgaagaaaaacagatagaccgccagcgcgatccccagaaacagcaccagccgatacagccaggtaatgatcgcgaaggtcaccagcaaacgccgctgaccggtcgggaacgtttctggccagtcttcctgcaaacccagcagattgcgccgcagcgtcacccgtgcgagtgccgaggcgcgttcgtgcaggttgggaaaatccagcaggtcggagaggatgaagtaaccgtcgaaacgcatgaacggactggcattcagcgccagtgacagcaaccaactggtggtcgccagatagagcaacgcattgcgcaacgcgcccggatcgcacaacgcccagcccagcgtggacaaccctgccagcgacagttcggtgacgatgcctgccgaggcaatggccaggcgttgccgcgagcgactgagtttccagctctcgccggtgtcggtgtaaagcatcggccacatcaccacaaacgcgatgcccatgtgtccgacgcgcaagcccaggcgcgtggcgaccaatgcgtggccgagttcatgcagggttttcgccacgatcagcgccaaggcaaaactgaacagaccttcggtggaaaacgactcgaccacggcactggtgaacacatcccactgctgcaacaccaggatgatcccgagcaaactcaggctcagtaccaaaatcccggtcaatggatgaaacagccaacccagtgcccgcgccaggtattgcaacggttgttgcggtcgcagcagcggaattcggaaaaacagatagtgatgcagccaccagcgccaggtcagccaactgccttcttcgcttttacttttgaggcgctcaagggcagcggggccggcgcgcagcaactggtgctgttcgagaaactggcggaagtcgagcacctgttcgacatccggtttcagtgcggtgccttcggcgatctgctcgctgattttgcgtggtgactggccccagcgcagcaggcattcgaactccagccagccaatgcggtagaagcggttgatcaccgtgtcctgaatcacccacgccggttcgccattgctgccatgggccgcttcgctcaggcgcaagtcttcgcgcaggggcggcacgggcagatcggccgggtcgagcattaccagccactccaggcacgcagcgtcgccagcggtcggcgtagcaggtaataaccgagcatcacccgcccaccgtagattttcgccgtgccatgcaggccaaggcgcgcatgttgcggtgcgccgtcgatgctggcgagcaggcgataagcgaccacaccttcatcgctgggccgcgcctgataactggtttccagaatctggcccttgagcggcgtcagcgggtaggcggtgagaaacaaggtgacctcggcgcccgggtccagagcgatcgcatcggcgacggccaattgaatcagcatggccggttgcgtcggatcggccacttgcatgatgcgctcgccggttaccaccggtttgcccagccagtcgttggggtcgctgaacaccgcgacaccgccgcgtggcgacagcacttgcgtacgcttgagctgcgcctgcaccgctgccagttccgccctacgttgttgggcgcgaccggcgagcaaggtcaattcacttttgctttgcgggttatcgaacgcccgttggctggccgcttgcaactcggcatcggcgacggcgacttccttgccgagcacttcggcgcgactgcgcagggtggtttcatcgagcgaaaacagtggtgtcccggcatcgacgggttgattcggacgcacctgaatcttttcgatcacgccatcaatcggcgagctgatgatctgcgcctgtcgcgagacgatttccgttggcgccaatgctgtttgccgcaccggcaacaacagcagcgcagcgagtacaatcgccaccagcagcagttgcttgcgattcggccgccagcgactgaaacgcttgcgccgggtcagcgccgaccagcaatacgcccacgtcgcgaccaggcctttgaggtgttgccacaacacggccggcggttcctgctccagcaagatgatcagcaggcccagtcgttgattgtcacgatcctgcaccggcacgcaccacagccccgacggccaccattcgttccagccttcggcaatgtctgctggtggattggcactgtcctgagcgatccacaccggctcggcgtcgggcacctgcgccgcgacccagcgactggcacggcgcagccagaccagatacggcgagtcctcgctgggccgtgacagccccgagacgttgagcaattccaatgaggattcacgctgggcaaacaccagcgcctgatgaaactgcagtaacggatacaagtcgttggccatgctgaacgccaggctgttcagcgagtcggcggccatggctttgtctcgcagcgcatcgagttcgagcagcaggtgagggtgcggcagcggctcgttcatggtcatgggcgtgcgacttgatcgaactgtgcggtgccgctcatgccggccatcaggtcggggtatttgttgtcgagccgggcttccagttcaacggtttgcgctaccgcatcgactcgcgagttgatgccgctgacatgggccgggtaggtcttgccggtttcatggatgctgacctgcagcggcaagcccggtttgaggtctttgagcaggttggacggcacattgaggcgcactttcaaggcaccgtcgctgaccagatcgaacaacggcgtgcccgccgtgacggtctgatacggcttgacgtagaccttggccacgcgtccggaaaacggcgcgagcacctgacaataaccactctgcgccgcacccatggcccgtgccccgtcagccttttgcacttcggtgttggccattgacacttcgatgtcgccaactgcattgagctggcgcagttgctgtttcgcttgcaggttctgtttggccatggccagttcggctgccgcaactttcgcccgcgcttcggcttcattgcagttgaagcgcgcgagcaattccgacttgctgacttgttcgccgaacccggctttcaattcacccaaggtgccggccatctggctggaaagggtcgtttccagttcggcggcgagcaacacgcggatcgcactggcactttccagggcgggggccgaagggctgtcttcggcgtggacgggcaggatcagactggccaacaacagggccccgaaacgggactcaagggcgattttgcgcattcggcgttccttgcgaagtggcagcgagcagacgttgttgttcctgttcattcaaggtgcgctgtatctcccgggccaacgtcttgatgtcgtgttgggagatttctttgggcagcacgtccaggcccaccgagttgtacatccgcccccacgcggcttgagcactggagaacgccgcttcacgctgataacgcgagagcagataacggccctcggagcggatcacttccagctccgagcccaaggcgccggtcttcgccgcttgcgcgtaatcgagcaggctgcggtcaacgcgcaggctgtcttcggcgaactcgacttcctgccgggccagttgatagcgcagggtgccgacgcgtacttgcgtgagaatcgccatcgacagcgccacgcggcgggtgtcgtcggtttcgctctgggatttttctgcggcgttcaacgacggcaattgcagcaggcgaatgaggttcatcgacacttgcaggccggtgctcatccagtcgttgttgtagaggtatttgttcgagtcgtacttgtagccgaaatcgacgctgacgttcggccacaactgcgccttggcgatctccaagtccttttgattgacgcgtttgcggtaccactcttccatgatttccgggcggttttccaacgacagctgttccagccgtgccatgctctggcgcacttccggcagcgccggatcgggcacatcggcaagcaccattttcgagcccggcggcagcgacatcagcgccgacagttcagcctgggcgaattccagatcctggcggcgtacggtcagcaggtagatcgagtcgaggagggcgcgttgataggcgaggatttcctgacgcggcagcaggccacgggtttcggcttcgcgggccgaggtcagtgcggtgtgggtgcgcatcagcagcttgtcgacttccggcatcaagcgctgggcgccgagtgcgcgccaataggcgttgcgcacgtcttgcaggacgttttgcgcgactttgcgccggcgttcttcggccatcaggatctggtcggatttctgttgcgtgcggtaataagccacgccgaaatccagcaggctccagctcaaaccgaggccgtagacttcgcgatagcgttcttccgaggtcgatgggcgcaagctgacctgacggtcttcgatgccgatcgaggtgccgccggaatcgttgtcacgtccggcatagcccgccgaggcgaccagacgcgggagcatttcgtggctggagacatcgcgcaggtccgaagccaatgcgctttccatcagcttgaggcggtagtcgaggttgtatttcagcgcccgcgcggccgcctcgtaaaaggtgatcggcgcggtcaccggctcctggccggaatacatgcgtgactggtcagcgatgatgcgctgacggttttcttcatcggtggaaggtttgggctccgttgacgagcaagcactgagcaacagtgcagaagcgatggcggtactgagaagccgggtcgcatttatgcgcatgttcattcctttgcattcttggaattttttcagttcgactgcattaccgtggtgctcgccgctgcgctgcatcgcgcaattgcgcgctgaagcccttggctcgtggtttttcctgttgtttttcagtgtgtgccgggctgtgcgtcagatccgccgggttcaaggtgaacaacgacggatcgctcaacagtccatcggcactcaacccggtacggccctgacgcccctgaatccatagcagatccagttcgctttccaggcgactggtgcgcaccgcttgctggacgaactgccccggcaccagccccagaccattgcccaccgactcactggtgaactcaccgaccgctgccagacgcaggttgctgccatcgacgccccaggccgacagctcggagatctccgccgcacgctcgaccacaggcgtgacgaagaccgccggttgcggatcggggatgaggaagttgcggtttagcgtgctcgggtcgcgctcgaagttgttgccgcccggcgccggaatgaatggcgtggcgatgtcgagagtgatcgccagttcggcctgatcgctggcgccgttgcgatcgttgatggtgtaggtgaacacgtcgcgcaggatctgcccgaggccggcggcagccagcaccgctgggttgttctgatcgatggtgtaggtatagctgccgtcggcgttcaacaccagcgtgccgtagaggccggtgatcggctgaccgatcaccccggcagtccctgagtcagcctcggcgccggtgcgaatcccgaccaccaccagactgtcgttgttgtcgacgtcgccatcgttgggcaatacgttgccggtggtttgcggcgccggcgcctgatcgctggcgaaaccgctgtcgttctgcgccaccggcgcgtcgttagcgccttgtatcaccacggtcaggcgcgcatccgaagtcgcgccggcggtgtcgaccatgcgataggtgaaggtttcgctaagtgtttcaccggcagtgcgcaaggcctgcaccacgggattgttgttgtcgatgacgtaggtgtagctgccatcggcgttcagggtcagttgcccatagagcccgatcaacacttgcccgacgccggtggactgaccggcctgattgctgacgctctgcacgtgtttgctttcgccattggccacactgtcgacgtcggtgtcgttgtccagcacattgcccgtggcgttgctgcccggcgtgccattattgacgccgccggcctcgaccgccgtggcgctgtcatccacggcaaccggggtgtcgttgcgcccgtcgacggtgatgcgcagttcggcggtgctggtatcgccccagcggtcgacgatggtgtagctgaacacttcattcagggtctggccgctctgccgcaaggcttgcacggcggccagattgttgtcgacggtgtaggtgtagctaccgtcggcgttgatcagcaggtcgccataaagtccgcgcaacgaggtgccgacgctgcccaccgtaccgatgtcgctgaccgtgccggtgtgaatgccgatcaccgacagcgggtcgctttcggcatcggtgtcgttgtccaggacattgccgccgggattgatccccggttgactgttgttactgcctccggcctcgaccgctgtcgccgtgtcggtgttggcctctggtgcaatgttgcggccacgaatgatgatgtggatttgcgccagatcggtctgcccgccacggtcgctgacctggtaggtgaagcgttcgttgagaaattgcagcggccccaacgccagaacggtcggattgcttgagtcgaggttgtaggtgtagctgccgtcggcgccaatgatcaattgcccgtagaggccgttgatcagcgtgccgttgctgttgttggtgcccgccgtgaccccggacagactgccgccagcgtcttcggtgccgaaacggatgccggtgacggtcttgctgtcaccctgatcaacgtcggtgtcgttgggcagcacattgccgctcggattgacgccattaccgttgccattatcggccacggcgagcgccgtatcgttggccgccaccggcgcatcccaggcgccgtcgatgcggatgctcaattgcgcgttgtcggtggcgccggcgatatcgcgcatacgataggtgaaggtttccaccagcgaatcgccgattttcaatgcctgcacagccgccagcgtgttgttgatcacgtagctgtaagtgccgtcggcattgatcgtcagggtgccgtacaaaccattgaaggtctgcgcgacaccgacgttggtgaaggtgccgcccgccgcttcgctgccagtgcgaatcccggtgacgactttcacgtcgttggcatcgacatcggtgtcattggtcagcacgttgccgctcggattgacccccggcgtgccgttgaacgtgccaccggcctcaactgctacggcactgtcatcactggcgaccgggttgtcgttggccccgcgaatggtgatggtcagggttgcgctgctggtggcgccggcgaggtcgcggatctggtaggtgaaggtttccgtcagcgtgtcggcattgctgcgcaaggcctggacctgcgggttgaggttgtcgaccagatagctgtagctgccatcggcgttcagggtgaggacgccgtaagtgccattgaaaccggcgccgatcagcccgaccgaggaaccttgattgacgccgatcacactgagcacttcgccgttgccatcgacgtcggtgtcgttgctcagcacattgccgctgggattggtgcccggggaggcattgttcgcaccgccggcttcgattgcggtgttgctgtcgttctgcgcgactggcgtgtcgttgcgcccttgaatgctgatgttcaacgtggcgcggtcggtggctccggccgcatcaatgacttcgtaactgaaggaatcgagcaggctgttgccggcgcgcaaggtctgcaccgccgccatgctgttgtcgaggcgatagctgtagctgccgtcggcattcagggtcagccagccatacgtgccgcgcaattccgtgccaagggcgccggccgtgccggttgcggcttcgctgccagtgcgcaccgaggacaccgcgcgggtttcgccgtagtcgtagttgggcaggtcgctggggacttcgccgccatcgacatcgctgtcgttgtccagcacgttgccggtagggtcctggcccggctggctgttgttcaaaccaccggcctcgatggcgacagcggaatcatcactggccagcggattgtcgttctgcccgcgaatcagcacgatgatttccgctgtgtcgatttgcggggtcgcaccgacgccatcgctgacggtgtaggtgaagcgttccgagagcagatcgacgttgcgccgcagggcttgaacgtcagggttgctgttgtcgacctcatagacgtagctgccgtcggggaaaatcgtcagcctgccgtacagcccggcaatcaccgtgccgccgagattgaccgcgatcggcgtgcctggatcagcagtcgcgccggacttgatcagcgtcaccgtcagtgggtcaccgtcgggatcggtgtcgttggcggtgacgtcgcccgaagggttgacgcccggcgtcaggttgttgagcccgccggcttcggtggcgacggcgatgacgttttgcgcaaccggtggatcgttgacgccatgcacggtaatcaccagttgcgcggtgtcggtcaggccggtggtgtcggtgacgcggtaggtgaagaactcggtcaaggtctggccgggagccaacgcttgaaccagtgcattgctgctatcgacgtcataaaagaacgagccatcggcaccaatgcgcaaggtgccgtagagcccgttgacgacggtgccgttggccgacgtggtacccgtggcaacaccgctcaatacatccacggccgggttataactggcctcgcttttgttgatcactccgttgaccagcaactggctgcttggctggtcgttggcatcaacgtcctgatcgacgccattgccgcccggttgagtgatcggcccgggacggctggggaactggatgacgttgccgcttggattgctttccgacgcggtgccattggttgatgccgcttgcgccgaagccgcgtcatcgctggccaccggattgtcgttggcgccctgaatgacgatgcgcagttgcgcgacatcatcgagcccgccggtgtcggtcagccgatagctgaagaattccaccagttgctgaccggcgctcaggcgctggaccgtggcgttgctgttgttgaccacgtagctgtaggtgccgtcgggattgatggtcaaggtgccgtagagcccggaaatcgccgtcgcgccgctgactgccgtgaaattgccggcgcccgcttcggccaccggacgaatgccggtcacggtgcgggtttcgccattggcggcgctgtcgacgtcctggtcattgctcagcacattgcccctggcatcgctgcccggtgtgccgttgttgacgccgccagcctcgatggccacaccgtcgtcatcgataccttgcggcgtgtcgttggcaccctgaatggttacgctcaacgtcgccgtcgaagtcgctccttcaatgtcagcgagcacgtaattgaagtcgtcctgcagggtctgacccgccagacgcagcgcctgcacggcagcgttgttgttatcgaccacgtattgataggaaccgttactgccaatcaccaactggccatacaaaccgttgatcaccgtgacgcccaacaccggcgtctggatgccggcgccagggccgaccgacaccacgtgcagttgatcggcgttggtggcgatatcgacgtcagtgtcgttgctcagcacgttgccgcgcgggtcaaccccggcggaagcgttgttgaggccgccggcttccactgctgtagcgctgtcgttgaccccgagcgggttgtcgttgacggcggcgaggatgatttgcagggtgtcggtgtcggtcagcgcatcggctgcggtgccgggaatcccgtcgccatcggcatcgccatagttgccacggtcattgctgagcacggtcagggtgtcggtgccgttgaagttggcgttgcccagatattgcaggctggccagcgcggtattgatatcggcgaggttgccggtcagggtcaggctcgcggtgttggccccgctgactgtcacgcccggcacggttgcgccaaggaacagcgtgccgtgggtgaccgtgagaatcacgctgatggcgcggtcgttgacgttcggatcgcggtcggcatcgacatcggcaacgctgatgccgccgatgttcaacacgacgtcttcctggccgttttgcgcgcccggcacggtgttcactggcgcgtcgttctgttcgacgtaaccggcgttggcgctttgcgtgtcggcatcgcccaaggtgatggtgatctggccaagagtgccggcatcgctgtcgacccgcacgcgcaaatccccgatcggttgcggataactgaccagcccggcgggcacgtcgatgcggaacacaccgaggggcaacacgccgaaacggtactggccgttggcgtctgtaagcgtcgtgaattgcaggttgtcagccgtggtgtcgaggcgtccgtcggcaccggcccaggtcagggtcacggtttgtccagccagaccggcgccatccggcgtggcgctggcggtcgggctgggggtgtcgttccacaatgtgccgctgatcacgccgagcccggcgttgtcgcgcaagatgtactgattcggcccgacggcgctgccatcgcgctcgccggtggtggtgccatcgacgccgaccgtgttgccgccccaactggtgaaatcttcaggcaggctgctccaggtcagcgtcgcgttgctgctggcgacgatggtcgagttgggcagatccaccgagtagcgcacctgaatctgcgcgccaacgtccaattgatcgaaattgacgctcaaaccgccgctggtgctgaagctgatgcccgccggcagattgcccggaccgtacgtcacgccattgatgctgacgctgagcaaggtgtagttgctgccgccggcaaagttatcgctgacttgcgcatcgaacgccggcagtccgccgttctgggtgaaactcaattgcacggtggcgttgccggtgctgccgctcggattcgggttgaaggtgacgatctgcttgtcgaggccactgaagctcggttcaaccactcgttcgaacaccgtgtcactgaccgcacgcccggcaccgttgacgatttcctgcgcggtcaccgccagttgcgcgccggcagtgttggcggcgatattggtcacgcgcacgttgaactcgatcgagatgccttccagatcatcgtcatcgccattgccgttgaccacgttaccgaggttgaacgtcaccacctggctgccatcggggttggtgatgacggtcaggcggctcggatcgaagatgccttgcggcgccagtccggacagatccgcagtgatcggcagggcttcagggctgttttcgttgccgttgatattcagcgtgccgccaacgatcaggttggcatcactgctcagcccgccgttggagatgaaagcaatgcgcagggcattgaccagcgcatccggcgagatgaattgcaagccgttggccagggtgatctgtatctgatagttggggttgttgccctcgggcaccagcaccaccacgcggtagcggatcacttcgccgacggtgacttgctcgacggtggcggtggtcgggttgggcgtcgcggtgtccggcaggccaccgacgcgagagatttcgatggcctgagccacaggaatcagcaaggtcgacaggttgcggtaatcgttgagggtgccgccattgagcacgccgtcgacgccgctacgttcgccggcattgccgccgtcaagactggtccattgcacgctggcgacgttggcaatgttcgacaaggcggcggcactggcgttgaccacgccactgagttgcaagacgatgctgccgcccttggcgatgtcgatattggcgccgctggcggtgcgcaactggccgccgacgatttcaaaggctacgccgccgttgttggtcgcgccgttctgatagagcacgccgaccagcgtgacgttgctcaactgggatggcagggtgtcgaggaaactgatgtcgaacgcactgaaatcgctggcgccgttgccgttactgatggtgatgttgaaggtcaccgtgtcgccctgatcgtaaccgccgaggccggaggttgaagtgatcacctgattgacctgcaaggtcggctcgcgcacggtcaccgtgggctggccacccgtgagggcaacggtgcgatccacggccaccgcgccattcggcgtgtcgccatccggatcactgaacaccagttgcgcattgttctgcagcgagacattggcctggttggcgataacgttattagccaccagttgcaggcgaatcacgaaggtgttgttgccggtcaggttatccgccgagacgctggagacactgaacgtccagcgcccgtcgacgccatcgccgcccaacgtgccgccaatcccggcgaaaccgctgaccagcacgctgccggcaaagtcggcgcccagcgcgccactgccggcacgggtggtgatgatctggtagccgaggccgttattgaaactggtgtccaggcgcatgcccggtggaatcaggtcttcgatgcgcaggttctgcgtggtgccttcgggcagggtgatgacaatgtcgtagcgcatgctttcgccaatcaccagatcgctgccggtggtatgggccgcgcttgagtcgccattgtcgagggtgccgtcggcgaacactttgccgatcactggcgcagccacttgttgagtggtcagatcggtaaggtcggtcggggtgaaatcggtgccgccattgacgctggcgtaattgctcaaagtggcggtggtctgcaggttgcggctggcctcgatggtggcgctgaccaccacgtcataactgatcaccaccacattggcaccgctgctatcggccgccgtgccgctgcgcccggccagcagactggccacgccacccgcatcaaggaagttgatctggttgccgctgacgctgtagtcggtgcccaacacaagcagcgtgccgtcgccgcgataaatctgcagattggccgccgccagactgccgccgacaaaactcaacccggagggcagggtgatactggtgctgacgtcaaacgcgccgccgccaccgctgttttcaatcgcggtgaccagacgcaaacggtcggcgccgtcgatgttgttgatgttgccgtcgaccgccgacaggtcggtgacactgccattgaacggcacgccggtgctgcccggcggattccagctgccggtggtgccggtgaccgtaccgttggagcccgagaccacgccatgtttgatgttgagcaccggctcggcaacggaaacaatcgccaccacatcggaggaaatcagcgtgcggtcggtgagggtggtctgctggctcgattgtgcgagtacgtctagcgaacgctggtcggcaaacggctgatcgcccactttgacagtgaagcgaatgacgatgcggctgccggtggtggtattggtcgcaaagctgccgaagtcgaagaccaccgagttgccattggcactggtcacgctgaccacgccgccggcattggtgttgcccgcgcccagttgccattgaccgacatcactgcccgaaccccaggtaatcccgttgacatcgaacagcggcaacggcaggtatgcggtgagtttgaattgctcgtaatcgccggtgaccaggtcgtaactcagctcgaaggtcacttcatcgccgggacgcaactcgccgttgcccggtggtgcgccgttgttgacctcgaccagattgatgtcgacgttgctggtgggaatcacgctggtggtggtcgaaccatcggtttcactttcgccggtcaggttgaactgatcctgcagcagcgtgccgtctaccgtggcggtgttgccgagttcatcgccttcgttgatgtccgggtgcgggttgcctgaaggcggtttgtaggtctggccgacgatggccgaatagcttaataccgcgaccaccgcgccttgcaacgtgtcgtcgaaggccagatcgccgttgagccagccacgaatattggaaaatgcattgcgcaacgattgcgcgatgtcgaacaccatcgaggtgctgccgtcagcattgttgaccacgctggtgaccagggtgatggtctgcaccacgccgttgatggtcaccgttagggtcggcgtgccgctgagggtctgaccgtcgctgagttgatcgcggacgaccagttgaccctcgttgaagaaatccttgccgaaggcgaagtagtcggaaatcgccaggttgagggtgtattgcagcgtgtcgccggggctgatgccggtgtggccgacgtcgttctgcatcgtcgcggttttcagcagcgtgatcgacttggcgatgaactgcgtgccttggccggtgccgctgaaatcgatagtggtgttcggcgcagtcaggtcgcgcgggtcgagcggcacccattgccccgaagctgtcggcgggccgagggttacggtgacggcatcgccggtgaccgggttgatcaccggttggccgttggcatcgacttccggcacatagaaggccaccacggtgtcggtcttgccggtcaggttgtcgtacgcgacggtgaacgagttgatgtaaacgtcattggccgcaatcaacacggcgatttccgccggattggtcaccacggtgccgtcgtgcaaagtgattgaggtcagccgtccgccggggccgggggtaatcgaattgacctggatattgtccggcagcggttgggtgatgacgacattggtcagcgtctgccccggtgccggcgtggcagacagggtcagcgtacgcacatagttggggccggtggcggtttcgccttccggggtattgatcgtttcgctgacggtaatcaccgtcgggtgcacgacgaaggcggcggtgccggcctgaatcaggctcggatcgttggtcgggttgtccagtgcatcattgccgaactcgaaaccaccgctggcgcggatggtcatgtcgggcgtgccgttggaaaacgcggtgtcggccagattgctcaggcttgcggtgacctgcacgccgatcaccggttgctgattggtcacgctggcgaacggcagttcaatcaccaccagtttgtcaccggcgcgcatgccgtaagttgcggcgttgatgatcaggaaattgccattggcgtccttggccagcggatgcgtggcgttgccattggcgtcgaacgtcagcacgtggctgatcaggttttgccccaggtacgtggccgagatgaaattgacgccgtcgtcgccgtccttgccggtggcgggcattgccaggttgatgaacggtgcgtaaccgacctgggtcgaggtattgctgaaattcacggtgaaggtgaaacgatcacccagcaaaacatcgctgccgcccgtggacaccgtcgcggtgggtgccgcatcggcgagcaaaccgtcgaaatgcgccatggcgaggctgctgatggcgatgcttttatcgatatcgccgactttggtttccagcgtccagtcgccgccggccttgctgctgccggtgtcgttgctggaggcgccgacatcggcaccggtccagcgggccagttcgctgaccaacgtctgcccggcggcacccgcgccgacgtcgcagccgtatagctgaatgtccgcgccttggctcaggttgccgcgccattgttcgagggttttgctcagtgaatcgatgttgtccgacgtgaccgtgcggctgccgagggtgaattgcccggcggcgccatgggacatgatctggatcgaatcgaccttgcccaattgcgccagggcggcggagatggccgccaaaccgtcttcaccggcgttcaccacaatcgccgtgacattgcccggtaattgcgcaagcaactgatcgcggttttcgatgcggctgtcgatcaccaacaggctgcgtgccgccgatggcgcctgctcggtggcggcgcgaccttcagtcggcgtggcgtggggaacttgcgcatccaccgccgcgggcggggcagcggggtcggtgtgatgttgctccacggtcgccgaagcggcggcgccgtcgaacagaattcttggttccaaagccaatgcctgacgctgcggacgcagatgtgccccgccgaacccactccgtgaaccttgcatgaccggccctcatactgcctgctgaatccttccattgagcgccgacgccaagcgacggacaaattcagcgtaggtcgtttcctacggttttccagcgcaacgggccgctatttcaggggcttagaccggaagcggagcgcaatgggataacagccttaggccatcaatgcgcaggggatttgtgcgcattggcgcagcccgatactggcgtctaggctggacagtcagtcgcccattcgggcgtcacgcccaacgcagggacaggagcggaaccgatgaaagccccagtcagtatggtctgcctgatgttcacgctggttctcgcgccgggggtccgtgccgatgatccgcccgcgacaccggccacacccgtaaccgatgcggcggacgacacgccgctggtcaacccgcaggtggtcgacaagctcatcgacatgggcgattacctgcgcagcctggcgaaattccaggtcgacgcccaagtctcgcgggacaccgttctggagtcggggcagaagatcaagaccgagtcggtcaacactctgaaagtggtcggccatgatcgtctgtatgcgaaaagcgaaggcgatgtgcgcacccgcgagttcttctacaacggcaaaaaactcacccagtattcgccctatctgcagtactacacgacggtggacgcaccggcgaccgtcgcgcaaaccctgcacatggtcgagaactactatggcgtgcaagtgccgatggaggatctgtttctgttcggcagcgaccaggagcagatcgatgccttgaaagccgcgctttacgtcgggccgtcgatcatcaagggccagctgtgcgaccacttggcgttccgccaggagggcatcgactggcagttgtggctgacccgctcggacaaaccgttgccgtgcaaactggtgatcaccaccactgacgacaagacctatcccgagtacagcgcggtctaccagtggaacctcaaaccgacgatcccggacagccagttcaccttcaaaccgggcaagggcgatgtggcgattgcgatgaaaaaaaccagcgatcagggagggcagtgacatgcacaagtcaatgacgtggagtctgttgatctcgctggccaccgcaatgttgttgacggcaggtttggtcgctgaggcggacgcccgggggcaacgtgcccagggccatgcccgcgccaacgtcaaccgtgcgccggcgcctcatgcgcaacgggcacagcgcatcaatgcgccgcagcgcgccaaccatgtgaacgccggtaatcgggtcaattcgggcaatcgggtgaatgccggcaacaacgtcggcaaccgcacctacgtcaataacagcaatcgcaacgtcaaccgtaacgtcaatatcgacaaccatcgcgacgtcgacattgatgtcgatgggcatggtcgttatggctacgacgatcactatcatccgatcgcaacggccgccgccgtgaccgcgacagtagcggtgacagcggcagtggtgggctcgatcttcaccccggcgcaaatgcccagcagttgcgtgcaggtgattcgctacaacgtcgcctacatgcagtgcggttcgacctggtaccagccgcagtaccagggcagcgatgtgacgtatgtggtggtcaacgcgccgtgatcaggctttcggtacccagggttgcatcagcgcgagcatgccgcgaccgcctcggcgcaacccggcaagaaaacacagcacgatcaggccgatcaatgtcgccagactgatcagcgtgacgccggccacgtcgtaatccttgaacatcggcagcagcttttccaccggcccgcgcagcaggtgaatggctttttccagcagcacgacgatcaataccaacggcaggatgaacaacagaccaccgatgacggtggtcttgatgaacttgaacatgacggctccttgaatgacgggcgatccgcgttcaaggctagctgatgcaggcgagggggagggcaaagatgaaaaatggcgagggagtttgctccctcgccacgttgacagcgccttagttgatccgtggatgctgttgcaccagatccttgcgcttggcttccagtgcggcgatttctgcgtcgatgtcttcgattttctgctcgatgttgtcatggtgttcttgcagcaattccttggcttcctccaggtcggaagccgccggcgctgcgccccgcagcggtttgttggcggtttctttcatggttacaccggtgacaaggccgaccacggcaatcaccatcaggtaataggccggcatgtaaaggtcgttggtgctttcgaccagccaggccacggcggtcggggtcaggccggcgatcagcaccgagacgttgaaggcactggcaagtgcgctgtaacgaatgtgggtcgggaacatcgccggcagggtcgaggccatcacgccgataaagaagttgagcagcacggcgaggatcagcaggccggaaaagatcaggccgatactgccgctattgatcaacatgaacgccggaatggcaaacaggaacaggccgatgctgccgaccacaatgaagggcttacggccaatcttgtcactgataaaaccaatcaacggctgcacaaacaacatgccgaccatgatcgcgatgatgatcaacacgccacggttttcgctgtaatgcaggttgtgcgacaggtaactcggcatgtacgtcagcagcatgtagtaggtgacgttggtcacggcgaccacgccgatacaggtcatcaggctgcgccagtgcttggtcgcgacttccttgaacgagactttcgggccgccggcgaggccttcgcggtcaccttgttcgagtttctcgacgtgctgttggaaggccggggtttcttcgagggcgtgacgcagatagaggccgatcatgcccagcggcagggcgaggaagaacggcagacgccagccccacgattcgaattgctcctcgcccagcgtggtcgagatcaacaccaccacgccggcaccgaggacgaaaccggcaatcgagccaaaatccagccagctgccgaggaagccgcgtttgcggtccggcgcatattcggcgacgaagatcgatgcaccggtgtattcacctccgaccgagaagccttgagccatctttgccagcaacagcaggatcggtgcccagatgccaatcgaggcataggagggaatcaggccgatggcgaaggtgctcagcgacatgatcacgatggtcgcagcgaggactttctgtcgtccgtacttgtcgcccaaggcaccaaagaacagaccgcccagcggccggatcaggaacggcaccgagaatgtcgccagtgcggcgatcatctgcgtgccggggtcggcgccagggaagaacactttgccgagcacataggcgacaaagccgtagacaccaaagtcgaaccattccatggcgttgcccagcgcggcggcggtgatcgctttgcgcatcttggcgtcgtcgacgatggtgatgtctttcaaaccgattggcttgacggttttcttgcgtgatttcatccgggttttctctttgctgatccatcttgccgcgtagatgccatctatttgatggcgcgtgctctttggctcagatacatgaggacacgaaataattcagtgtttggcgctttttttccctgaggagagtgtaggagctgccgcaaggattgccttgagcgcggaactctcggcgtaggcaagggcgatgatgaggaatattgcctgctcgacatcaaggaagccgtcggcgccgctgcacctcgagccgcccgatttgtccgcgaactgttgccgcaggacatgaagctggaactcgatcagttgagtcagcgcgatgcgatgctcgcggccatgtatctggcgcgggtcgtcggcgtggcgcatgcccggcaaatggatctggctactcgatccgagtggatggcggatctgcaaacctgccgaaccaaacttcttgatgcgccgtcctggctgtggaccagtgtcgtgcaactggttggcaatcacgaaaagggctatctggaacactgccggcgttacgcgctacagcattgaccgcgttattgggcgagacccgccagcgcaatccccaacggctgacccgcacccgacgcggcggccttcatttcattgcgataaccgtgcgggctggtgcccaagtgcttctggaaggcgcgacgcatgcgctcctcgcggccaaaacccgctgtttcggcaatgcgcttgatcggttcgctggtggttttgagtaatcgggtagcggtctccagccgcaggttctccaccgcttgcgccggggtttcgccagtggcggcgacataggcgcgggcgaagtgacgggggctcatgccgaactgctctgccagccgttcgacgcgcaaatcaccgttcagattcgccgcaatccacccgtgcagccgggccagacgcacatccggatcggtgcgcagggctttcgattgagcattcagcgaagcgctgagctgcggttgttcggcatcacgccacataaacaccgtgaaataccgcgccagtgcgagtgccgtgtgggcaccgagatcctgttcgaccaggccgagggccaagtcgatgcctgccgtggcgcctccgcatgtccagaggttgccatcgtgcagataaagcgcgtcggtgtggcagtgcacagcggggtaacgcgcctgcagttcggcggcgaatttccagtgcgtcaccacttgccggccatcgagcaggccggctgcggccaaggcaaaggcacccgtaccgattgaacagagccgacggatatcaacggagcggcgccgcagccacgcgcaggcctcttcgtcggcttcgagggcggccatgcccggtccaccggcgacgatcagggtgtcgatcagcggggcgatgtcatcgatctgctccagcgaacaggtggtcacgctgatcccggaaatcgacatgacctgaccgcctcgcggcgaggcaatcagcaagcggtacggtgggcttgcgctgtacggctcacccaacactcgcgcaatggcggcgaacacttccagcggcccggcggcattgagcagcagcagatcatcaaaggccaaaaccaccacggtgcgtgtgtccgctgtggcagcaaaggaggggtgtttggcatggagcgacacggcgggcctcgacatactgaaatcactgcacaaatgagcctccgacaatgccggtaaaacttcctgctgccaagcgtctgctggcgctccccctaaaagcgctgctgtgcagcgttgccttgttgttcagccaagcgccgttcgccgttgccgaaccgttgaaggtcggcgaccaaagcggcctgactcaagccttgctccacgccgccggcgaagatcaaaaccttggctatgcgctgtcctggcacccgtttttggcaggcaccaccatgcttgaggcgctgagcgccggtgctatcgatgccggtgtagtgggcaacgcgccgccggtgttcgctcaggcgggtggctttgatgtgcgcatcatcggcgtcgcaagcggtgcgcaaaacaacaatgcacttctggtaccggaaggttcggcagccaagcaggtttccgacttgaaaggccagcgcatcgccgtggccaagggcagcagcgggcattatttgttgttggctgcgctgcaacaagcgggcctcaccccacgggaagtgaacatcgcctatgtcagcccggtggatgcgcaaaatgcctttgccagtggcaagctcgatggctgggcggtctggtatccgttcgttggtcaggccacctcacgtggggcgcgggttttactggatggcagcgcatggccggaaaccgggctgaattttaccgtcgccagcctcaaggcactggacgatccgcaacgggcagcatcgttaggcgatctgctcgccagactgacccgagcccaagcgtgggccaccgcgaacccgcaggcctgggccgaggtgttcgcgcaaaccactcgactcccggttgccctggtgcaagagatgctcgccaaacaggcgctgcgttacgtgccgatcgaaccttcggtcatcgcctcccagcagcatctggccgacctgtttgccagcgaacacctgattccgcgaccgttgaaagtcgagcagatcttcgacgaccgcttcaacccgttactgccgcaaaacccataacccattcagttcaccttgccgcgttgctcgcggcgcggattcatacgcctggagaaaagtgatgcctgctctcgaaaccaccaccctcaaacgccgcaagaccgggctgatcgcagtcgatcctgcgcgcagcgctggcggctacacgctgttcgccccgcaaaccgcagacggcaacgtgttccttatcgacctagatggcgaagtcgtccaccgctggaaactgccgcagcgccccggccgcgacgcggtgatcctgcgcaacggcaacctcggctacaacggcaaccatccgcattcacccgacctgtttccgggctggtcggtgtggcacggcggcgcgttcagcgaagtgacgccggacggcgaagtggtttgggaacacacggatctgctgcatcaccacgatgcgcaatggctggacaacggccatctgctctacaccacggccgagccgttgagtgctgagctggcccgtcgggtggtcggtgggattcccggcagtgaggcgccgggcggggtgatctatgccgatgtggtcaaggaagtcgatcgtcagggcaatgtggtttgggaatggcgcagctgggagcatctgcaaccggaagactatccgctgcacgaggccttcgaacgtcaccactggccgatgaccaacgcagtgacgccgggccgcgacggcaaggtgattctcagcctgcgcagcgtctcttcggtgattgccatccaacgtggcagcggcgaagtgctgtggcgtttgggtcacgatctggtggcacagcagcattgcccgagtgaactggaaaacggcaacgtgctggtgttcgacaacggcatcttccgcccgcacgtgagcatgccgcactcgcgcattctcgaaatcaacccggcgacgcaacagatcgaatggcaatacgccgatacgcccggctacgcgtttttcacgccgttcatgggcggcgcgcagcgtttgcacaacggcaatacgctggtgaccgaggccaactttggccgcttgttcgaagtcagcccggcgggagaagtggtctgggaatacgtcagtccgcacttcgccagctaccccgatgccgcctcccgccgttatctgccgggggaaaacaacgcgatcttccgtgcccatcgttatcagcgcgccgacctgccttggctgcgtgactgaacacgcccgaacctccaccgcaacgatcacgctcacgcaggccacgcgcagcgaagtatcgactcctctcgaagagcggcttcaggccgctccaggaatcaccgatgaaacttctttattcgcgcaacgttagcgctggcgccctgggtttgtgctcgttaatgccattgctcccggcaaccgccagtgatctgcccaacaacaatgatgtgctgcaaaccgtcaccgtcgaatcccggcgccgcagcgaagacgcgcagcaagtgcccacggcgatgagcgtgcttggcgcgcaaaccctcgaggaacaacgcctgtatcgcctgcaggatttgcagcaggcgatgcccagcgtcaacgtcgcgttcatgcacgcccgtcaatcgagcctgtcgattcgcggcttgggtaacaatccggcgagcgatggcctggaaggcagcgccgggatttatctggacaacgtttaccttggtcgccccggcatggcggtgttcgacctgctcgacgtcgagcagatcgaactgctgcgcggcccgcaaggcacgttgtttggcaagaacaccacggcaggcgtgctgaacatcaccacgcgccggccgtcatcgacgccgcaaggcagcttcgccagttcggtgggcgaggacggttattcgcagaatcaggcaagtttttccggcccgctcaatgacacgctcagcggtcgcatcgccgcctacaaaacctacgaaaacggctacgtgaaaaacgaattcgacggccacaccctcggtggcggcgtgcgtcagggcgtgcgcggccaactgctgtttcagcccaatgacgatttcaatctgcgctggctcgccgattatcatgaagaggattccagcgctggcacgcgctcgttgttcagcaccgggccgaccatcaacggcgtcaaccgttatgagcaacgcgccgccgctgtcggggcgacgctggtagacgggcgtcgggtcaatctggacgccgatcagaacgtcacggtgttccagggcggcacgtcactggaggcgaactggaatctgcgcaacgattacacactgacctcgatcagcgcttatcgctggtgggatttcaccccgcgcaacgacgatgagttgaacgttgatgtgatgcacaacgtcgggcaatcagcgcgggacaaacaatactcccaagagatcaggctggcctcgccggttggcgaacacttcgattacgtgctcggcgcttattacttccgccaggaaatgagcaacaaggtcttcaccgattacggcccgctcgcggacacctggaacggcaccccgcaaggcgcgctgaacaacgtcaccagcgtcggccacggcgatgtcgacaccgacagtttcgccacgtttgcccaaggcacttggcacctgaccccggttttggatttcagcctcggtgtgcgcggcacttatgaacgcaaactggcgcaggtcacgcgcaacgctccgctcggaggagccggggtcagcggcgcagcagcggctgccagggcagggcggagcggtgcttacgattccggggatctgagcctttatagcttcagcccttcggcgctggcgagtctcgcctggcatgtcagcgatgaggtgctggcgtatgcctcgttatcccacggcgagaaatccggaggggtcaatctcagtgtggcgagcgcgccagtcgccggggctgattcgctgttgatcggcagcgagcgggccaatgacgccgaactcggcataaaaaccacgctgctcgatcagcgtctgttgctcaatgccaacctgttctggaccgtggtgcacggctatcagaccaacgcttatgacgacgtcaatctcaccagttacctgaccaacgccggcaccgtgcgcagccgcggtctggaactggacagcagttggcggccaatctcggggctgacgatcaacgtcaatggctcgttcaacgacgtgcgctatctgtcttacgacgaggcgccgtgcccggcggaagtcgcgctgcgcccaggcgcgccggccgcttgcgatttgactgggcacgcggtggtcggtgcgtcgaaatggattttcaacagcaatgccagttatcaatggaacctgcaaaacggcctgcagccctacgtcaatggcagttacgcgtggcgttcccatgcggtcggcaccgtcgatgattcccgcgaggcgcagttgccgggctatggcctggtcaatctgtccagcggagtgcgcggcgattggggcaaaggccagtgggacgtgtcgctgtggatgaaaaacgccttcgacaagacctattacaccacgctgtggaattcacccaacggcgcttacaccggggtgttgggtaccccgcgcacagtgggcatgacggcgcgatatgacttttgaccggagcaactgcgggttgcctgcgtgaaattatttctgtagattttcatgaaattataaaaagataatttcatgaggtcgcgaatgtttcagcagtccagccagcacgtcgacagttattacgctcacagttgcgccgatattctgcgcgatcggccggttctggagggcgagcagaacgccgatatggtgattatcggcgccggtttcagcgggctgcacacggcgctgcgactggcgctggccggtaagcgcgtgaccgtgctcgaggccagccgtgtggcgtgggcagcctcggggcgtaacggtggacaggcgattctcggctggtcgtgcgacatgccgccgctggaagctgcgctcggccatgaacgcgccaagcgtttgtgggacggcatgcgctgggcgtctgaagaactgcgcgagttgccgggtcggcatggcttcgattgcgactatcggcccgggcacttgtggacgtcagtgatgccgcgtcgggtcagtctgctgaccgaatggcaacgcgaggccagccacaaatggggccacgatgacttgcagttcatcccccgcgaacaattgtccgaatgggtcgccagcgatcgctatcaggccgggttgtacgacccgcacggtgcgcacctcaacccgctgaaacttgcattgggcctcgctgccgccatcgaacaggccggcgggcgcatctacgaacaaagcaaagccttgagttattcgcgggagggcgctggcttccgggtcgtcactgaacgcggttccgtccgtgccgatgtgctggtgctggcctgcaacgcttacctcgatgaactcgacccgcaactgtctggctgcatcttgccagtcggtacttaccaagtcgccacggcgccactgacgccggagcaggccaccgcgctgctgccgagcaacgtctgtgtcaccgacaaccaattcgttctcgattacttccgccgcacaccggacaaccgcttgttgttcggcggcggctgcacctatctgggcggcatgcccaaggatatcgccgcggcaacccggccgtttcttcagcgcgtgttcccgcagctaaaaggcgtcgacgtggaattcgcctggggcgggcacatcgatctgactcttaaacgcacgccggatgtcggttgcgagggtaaccgttactggctgcaaggttattccggtcatggcgtgttgccgacgctggccgctgcgcgtgcagtgtccgacgcgattctcggcaacgcagatgaattggccttgtatcagggcttgagcaatggtcgtttccccggcggcaaacatttcgcagcaccgctggaggcgatcggcaaagcctggtatcgcctgcgtgacagcatttgaagaggccatttctggatacccgacgatgaacaagcaagaagaaatcgccgcgctggcgatcctcatccacgacctgcgcaagcacaagaagtggaccctgaaagaactggccgacaaaatcgggcgttcggtgggcttcctctcgcaagtcgagcgcggcttgtcgcggcccaccgtcgccgatctcaccgcgatcagcgaaaccttcggcgtgccaaccacctatttctatagtttgcccaagcctaaagagctgccgtgggtcacccgcccggacgagcgccgcacgctgtattacgccaacggcatcaccgacattctggtgtcgccgcagatccgcgcctcgttctccatgctcgaaagtcatctggaagccggtgcgagcagcggcgagcgccatctgaccgacagctcggagcagggcggttacgtcctcgaaggcgaactgacgctgtggctgggcgacgacgaagacccggtcaccctgaaggccggcgacagtttccagttcgacagccatacccgctgccgctacggcaacctcaccgagcagctcacccgagtgctctgggtctatacctgagaataataaaaggatgaacacgatggacgctgtctgcgccggtttgctcgctgaagtacgtgcgtttcgccaacgctaccccgaggtgcgttatgtcgacctgatctccctggacattcccgggcacttctacggcaaacgctacccggtcgacatgctggaaaaagtcgccgccggcagcgccctgaaactgccgcaaaactgcgtattgctgggcgtgcagggcggtttgttcgagatcggcgattactgcttccacgacggtgaccccgacgccgtgcgccgtctggtgccgggcacactcaaaccggtgagctgggaagcgcaacccttggggcagatgctgatcacctcggacggcactgaaaaaccgatcgaattcgaaccccgtgaagtcctcgcgcaagtgctcaatcggctggcgcgcaaaggcattcacccggtggtcgcgttcgaactggagttctacctgttcgataaaaagctgcgcgacggcctgccgcaattcccccgcgatgaactgagcgacgacgccgacgatcagccgaacatgcacatcgaacgcctgtcacgcttcgccccggtgctcgacgaaatggtcgaagccacgcgagcgcaaggcatcgacgccacggtgatcaccgccgaactcggcccgggtcagttcgaaatcaacttcggccacctcgacgacggcctgcgcgcagcggactgggccgccttattctgccgcagcacccgtggcgttgcgctgaaacacggctaccgcgccagtttcatggccaagccttatctgcagcaccccggcagcggcatgcatgtgcatgtcagtctgtacgatgccgacggcaacaacttgctggcggccaacgaacaacaagcgctgcgccacgccgttgccggctgcctggaactgctgccacacagcatgccgatcttcgccccgaaccagaacgccatgcgccgcctcggcggcacggtgaacaccgcgaccaaagccagttggggctttgaggatcgcgatgcgtgcttgcggattcccgagtcggatgagaagaacctacgggttgaatatcgactggcgggagcggatgccaacccttatttggtcctggcagcgatcctggtggggttggagcatgggctggaggcgggcaaggaaccgattgcgccgctgaacgaagatcgcaacagcggcattgatttccccaaggaaatgttcgaagccgtgcgcgcgatgcagcatcagccgcagttgcgggcgggattgggtggggagtttgtggatgtgtattgcgagaataaacggcaggatcatttggcgttcatgcaggagattggggcgcgggagtatcggtggtatttgtgagggggggagaaagggtagggtgaaatcgtcagtggttgttctcggccacacgcagccatgcgaagaatttccttcgccggaaggcttaattgggagtgtatgggcccggcatgcctgtctcagtcgctgcccatgcctcttttgcgcacccaattgatcaccagcaaaacccctgccgcgatcccttgcgtcccgcacatgacccagatcagagctgtgtgaaaaaggaaccaggaactcaaccccaacagcattgacagcacgacccccagcaaaagcagtggcaggtaccgtaccgtgggggcgtcttccagtgcgtcagcgaagatgctccagcaggcccattgtgagtacagggcgagaatcaataccaacagaacccgccacccgcctgttattggttctgaagtgaacacggcgatcagaaacgcgatgacactccacagggtaaaaacaaacgtggtgctggccggcacggtgtaggcgggaagggccagggcgatctggatcagcttgagagtttgcagtcgagtcatcactacgcgctccttgcgagaacattgaacaactccgatggcttgcgaagtgactatagatcagcgcttcaccgggcgcgtgcgtgctgacggtgtcacgaaacaaagcccgccgcgcatcatgtgccactgcggcaacaacgcgaccagacgcccatccgccaggcattcactggcgatgaactcgggaagttcggcgagggccgagccgtggcataagcgtcagcgttggtcacccgcagcggaccgtcagtgagcacagttgtgtagcgctcacatacctcacagttgtacacgagccaatcaccggccgtgttgaacacacacacacacactttttcacaaagacctcctatgcaccaatcaatggcaaaatccccctttgatcggtttggagaccccacatgcttcgtctattcgaacgaagactcgaccctttccctcctgatgaggtgccgccaccgcccaccggtctggcgcggttcctctgggcttgtacccgtggcgcgcgtggttatgtgctggccttggcgctgctcagtgccgcggtgtcgatttatgaggcgtggctgttttccttcctcgggcaggtggttgatttgctctcgacctggcaggccggcggggaagcggcggcgcaggagacgcgggtgttgtggggcatgggcattgtcatggtgctcagtgtcggactggtggcgttgcgcaccatggtgcagcaccagattctggcgattaacttgccgttgcggctgcgctgggatttccatcggttgatgctgcggcagagcctttcgtttttctccgacgagttttccggtcgggtcacgaccaaggtgatgcagaccgctttggcggtgcgcgatgtgttgttcacgctgatcgagatcctgccggggatcggtgtgtatttcattgcgatcattgcgctggccggcggctttgcgctgaagctgatgttgccgttcctcgcctgggtgattttgttcgggctggcgatgtggtacttcgtgccgcgtctgggcaaggtcgggcaggagcaggccaatgcgcggtcgatgatgaccgggcggatttccgatgcctacaccaatatcaccacggtgaagctgttctcgcactccaatcgtgaagcgcattttgcgcgggcggcgatggaggatttcaagctgacagggtttcgccagatgcgtctggtcagcctgttcgagatcgtcaatcaggctctggtggtggcgttgatcatgtcggcgggcggttatgcgctgtggctctggcatcagggcgaggtcggcgccggtgcggtggcggccatcacggccatggcgttgcgcatcaatggcatgtcgaactggatcatgtggcagatgacgtcgctgttcgaaagcatcggcaccctgcacgacggcatggagacgctcacccagggcaccaaggtgcaggacgcgccggatgccggcgtactgaagacgtccggcggcgcggtgacgttcgacaacgtcagcttcaattacaacggcgaacggcaggtgctcgatggcctgaacctgagcatccgtccgggggaaaaaatcggtctggtgggccgctccggtgccggtaaatccacgctgatcaacttgctgctgcgcttctatgacgtcgaccgcggggagattcgcatcgacggccagaacatcgcgcaagtaacccaggacagcctgcgcagttgcatcggcatggtcacccaggatacgtcgctgctgcaccgttcgattcgcgacaacattgcttatggccggcccgatgcgaccgacgcgcagattcgcagcgcggcagccagcgctcaggccgatgagttcatcagccaactcagcgaccgccagggccataccggctacgacaccctcgtcggtgagcgcgggatcaagttgtccggtggccagcgtcagcgtgtggcgattgcccgggtgatgctgaagaatgcgccgatcctgctgctcgacgaagccaccagcgcgctggattcagaagtcgaagtggcgattcaggaaagcctcgacgagatgatgcagggcaagaccgtgatcgcgattgctcaccgcttgtcgacaattgcagcgatggaccgcctgatcgtcatggacgaagggcgcatcatcgaacaaggcacccacagcgaactgctggaacgcaacggcgtgtatgcgcggctctggcaacatcagagcggcgggttcctcggtgaggatcaaggcgtggcggaggttctggatcaggcctgatgttcgaacacaaaaaaaccggcattgcgccggtttttttgtgcctgcaaacccgagggtttacagcgacgctttcacctgcagaccaaacaccaacgcattgtcgatgtcctgcccggagaacgcgcccggctcgatgatgtattgcatgttcggacgcagggtcagccatggcgtggcttgatagccgtagccgagctcgatcagttgttcggcgctgtccaggttcgggaacgcggcgccattgtccagcgcggcgtcttgctgcacatcgcggctgcgcgggttcggcacggcgcgaccgtagcccaaagcgacggtgtcacgcgggcgaccttcgaacggtttatacaaaaccacgccggtgccgtaccacttgctgaacggcgaagccgcttcgctggccgccgagtattggccgaaggcatgcaggctgcggccttcggacgactccgagcgccaaacggcttgatcgaccaacagataatgaccaccgcgaccggacacttctttactgctgccgatgcgtttcacgtcggagctgtcgtagtagtaaccgactttgtattcacccggcagctcgcccgcgtgcttgtacaccagctcgatcggcaccacggtgccggtggtgtgtttcgggcccaggtgccaggcacggctggagttgccgttgctctccggatcgacgttgaacgcggccacgcgcaattgccacgacggcgacagatcgtatttcacccgcacacccaagtgcgcgttggggtagttggtccagccgctgccaccggacatgttcagcgggtgaccgcagaaaccggcgttcatgaagttgcacagaatgccgctgtcgaggccaccgaggtcattgcccatggccatgtaaccgagtttcacgttgagcgccggggtgaacaggctgcgctcgtagctcagttcggtcaggcgcgtgtacaagccgccgtagttttcctggatcggcaaacggttgccgaccaagtcttccgaagcgctgttgccgcgacggtcattgatcgtcagttggactttaccggcgttgtcgaagccatacagtttgctcagatcgaactgcacgccgagcttgatgttctgcgagtagcgcgccgagcgatgcagtccgccgtcagcgttgtaggctgtttcgccgctgtaatcgccggtgaacttgatgccttgttcatccatctggtgacgcaagccaccccagtcgccggtcagggtgctgcggctcaacagatcggcatcgttgtccgccagcgcggggagggtggtggtgcacgcgacgcccagcaacaggcctttgaacaggtcggaacgggaaaaaccaacagccgatagcatgtaaatcttcctgcagaaaacatgagcaataagggggaaagcagcgcggcacccgaaggtgccgcgctcaaagcaagcgtccgcgcttaacgtggacgcagtggtttacggcaaggcgtaagccatcacgtagtcgccgcgatcggtcgactgacgcgcgccaccggcggtgatgacgatgtattgcttgccggttttcggcgaaacataggtcatcgggccgccctggctgccgactggcagacgtgctttccagacttcttcaccgttgccgctgttgaacgcgcgcaggtagaagtcctgggtgccggcgatgaagatcaaaccaccttgggtcgacagggtgccgccgagggttggcagaccgatcttgatcggcaagtgcatgcggatacccagtggaccggtgtcttcaacggtgccgaccggaacctgccaggcgattttctgggtcttcatgtcgatcgccgtcagcgtgccgaacggtggtgcctggcaaggaatgccggctaccgacaggaagcggtttttgttcacggcgtaaggcgtgcctttcagcggaacggcgcccataccagtgttcagcgcttcgcctccgccagcggcctggcctttgttctgcgacgggatcatctgaatccacagacccaggcgcatgtcgttgacgaagatgaaaccgtgtaccgggtcagtggagaggctgccccagttcatgccacccagcgaacccgggaagctcagcgatttgtccatgcccggcgcggtgtacaggccgtcgtagcgcatgcctttgaagtcgatgcggcagagcaattggtcgtatggggtggcgccccacatgtccgactcggtcaggtgctgagcaccgatttctggcatgcccaccgatttcggctgagtcggggagtacggttcgttcgggatgttcgccgctttcaccgggacttctttaacgtcagtcagcggtttgccggtggcgcggtcgagcacgtagatctgcccggccttggtgccgatgaccagcgccggaatgcttttgccgtccttggtgaagtcgatcaggctcggctgcatcggcaggtcgaagtcccagagatcgttgtgcacggtctggaatacccaacgctcgtcaccgctggtggcgtccagcgcgaggatcgaagcaccgtaggtgtgatcgagtttgctgcgctcgacaccatagatgtcggtcgacgagctgcccattggcaggaaaaccgtgttggtcgccgggtcgtaggacatcggtgcccagctgttcggcgtgctgcgcacataagtgttgccttcggctggtgcgtttttatcctgtgggttgcccgggtcgaacgcccagcgcatggcgccggtgatcacgtcgaaaccacggatcacgccgccgggcatgtcggtctgcacgttgtcagccacgcgaccgccaaccaccacggtggtgccggccagcagcggagcggaggacaactgatagtagctgtccggcacgttacccagaccggccttcagatcaacctggccgttgttgccgaaaccctggcagaactcgccggtgtctgcatcgaccgcgatcaggcgcgcatcgatggtgttggtcagcagacgacgctggcaattggcggccggcgcaggcttggcttcgatgatcgacgagttgctcggctgagcaatcgctttggtggcgtcgaaataggccatgccacggcagcgctgccagactttcgactgcgcgttgatcgcgttcttccacagctctttgccggtgtcggcatcgagggcgatcaggttgttgtgcggggtgcagatgaacaccttgttgccaacctgcagaggggtgagctgatcttcagcgccgttgccatcgctctcggcgacgtcaccggtgtggtaggtccacgcgactttcagcttgtcgacgttgttgcggttgatctggtccagcgcggcgaagcggctgccaccttcggtattaccgtagtgcgcccagtctttttgcgccttgtccggctcgaccggggtcaggcccgggccggtgccggttgcggcaacggtcgggtgcgcgacaaacatattgccggccgcgacaaccacgccgaccgccagcaccgccgccacggcgtaagcgccgcgaccggcaacaccgccgttggcacgcttgagcagcggatagaccagcgccacgaccaggccgatcacgctgaacatgaacaggcgcgagaacaccggccagaacaccaggccagcatcgatcactgcccagatcgcggtgcccaccaggaacgcggcgaacaaccacgcaccggcaagcttgaagcgcgcgatcaacagaccggaaacggccatgaccaggccacccagcaggaagtaccacgagcctccaaggctgaccaacttcacgccgcccgcagccagcgccaagccgagcagggcgatgacgacgcccagcccgatcagaatgaattttgatatgcccgagaggcgttgactctgcttcacgttgagtgtcccgttgaaatgagacgcgcattatatagttaggtaactacctagttaaatcactatttcagaatgaagcgtagtacgacatgcaatcccgtgcgcgatcatgatgtgagcgccacaggttgtcgtgctgacgctattggaatgctgccatacagagttttttgccaatgatattgtgacttatgacaggaattctctcggcgcaacaattgcgatagagcggtatgaaaaagaatggacgggtcaagacgccgcgcgacctaggcgagcggtgtagaggcggggcggtggatgctcatcaatttgctttaaatcgcagcaattgacagtgcttaaaattatcgtcatgacctttaataatagtgtctcagtgatatcattaaattcattttttcttaatccctgaagcggcgagtctggaaagtcagagggcaaagactacattcctctggttgtgacggcttgtgcaggaataccgactcagcagaatccacaaggaacattggatgaaaagcccagagctattgcttgcgaacctgaatcgagttgtccgcgaactgcgtggagctatcacctatctggaggatgatgatttagcgactcaaatggactcggtcatccgccgtctgtttctcgcgcagcttttggcaacagagcaaattatcgcgattggtggctcccagggggcgggtaaaaccacgttggtcaggctgatgtatgaccttcacaggaatgaggaatctccggagaaaggctggttacccgccaattcgggacgaggtgaaagcatgtcggtgcttgtgctggaggacgacactgtcgataaggctcaaggttatctgcgtgtacttgtggagcagccggatttgcctgggcattttcatatcgtcgaacgcaaggccgcttcggaagctgagttccgcgaggccagcagcgggaatcttcagggtgtcatgctcgcggtactgaaggtgccgcggcgttactgcaggcacaacggccagggctttatgctgatgcccgggtacgagccggtgcatgaagagaatcaatcctggcagacactcatgcgccaggcgctggccgcatgttcgggcaggctcatcgtgaccgatgaaatacgtcttgccaacgcttctcagttggcaatccagcatgatctgcatgccagtcacctggcgggcactgattcgctgatcatcgtgaccaaaaccgaaggctatgtagatgcaccgctgaagttacatgaactgtgcctcagtgcagcacaggcatttgacatcgcgcctgagcgtcgggatgacctgatcattttcacaggatccagtgaaagcagtgtcgagcgatggcgaccgcagttaattcaggctcttgcaacggttcgtgagagtacggctgcgagtcgtgagcgccaactgcagcagctagagcaattgctcagtcacgacctcaattatgcgctggcgggcatccgcagcaagtttgccttgcatgctgcggcagaacagagcgttggttatcaaatcatccagcaagccctggaggtattcgatcaggcaagggacagtttgcgtgatgagtacaagagaggcctcagagagtcgttgatacgtcaccacgagcgcgcctctgatgtcatggaagcgctgctgattgagaaccatgaaggggtcatcaacaaggtcgccagcattttcgataccgtcacgcaaaagcatgtcagccttaatggtgatatcaggcgtgcgtgggctgagcccggaaactatctggatactcacatcgatgtgctcggcaaactcaccagcatcaagctgggggcgccgcaggcattcattgaacaggttaaaaccgacgatcgcgactcaaccaaactcgcgcgtctgggttacagcaataatcagaaccaatccaccgagtggagcaaggtttcgccggacaccttgaaaaatctggctgtcgtgttctatcccgatcgagatgacgaggggcttgcgggcaagttcagcaaggagatgtcccgcagcctccagttgctgcctgcgatgactctggaatatgcgcgtataggcagtttgttccccgaggtatttggcatcaactccaataaccttcagccaatggatggtgaggatgggattgcggccgcggagcgtatccagaacgacttttctgctttgcaaaaggtcggcagcaacgtggtgaagggcattgctctgatgttggcggtcgatgtcgccgccgatggccatattgacaccattccggcgttattcaacgcgttgggcattggtggcggaacagccggtatgaccttggctggggcggcaactggcatggtggcgatcggaatgctgacctacagcgtactaaaggaagtggatcgccaggatcggcacacccgcaatcacgccttgaatgtgctgactcaattcaaagagcacttcgaggcacactttcttgagcagtttgacgttctcatggatcaagtgcgtgcgcgtatctacgacaacctgaccgttcgctaccgcctcgacgaagccctcgtgcgtcgagacagaatcgccaaagcgttggctgatgtcacttcattacgtctcgaccttcaggacgagatcggtgcgcgtgcgcggccgctgcttgcatgaagctgcaggcttattggcgagagttgcaccataggcgccttgactgggcacacaaagcctacaaggcatttatggatagcctcgatgctcgcgtgcgcgcttgctttgccgatagtggcacagaggcgtcagttgcgctgtttggtcgtacgcaggtcggtaaaactacgcttttgcttaatctgttgggtatcgacgagcagtatcttccccaagtgagcgtggtgctgcgaggtggtcggggcgtagggcagtcatcgaccgccactgccatgcaatatcaccgcgcagcggatgacaattggcacttgaaggtcaaccagcaaaaaatatcggtgagcgagcagcaagtaataaaggccttggcgcaacttcgcgtgagcgtcgagagcggcgactctctgccagacgatccaatagaaatcgcgatccccaggaaatacttctcggagcgatctcaagcgcgacctcaggtacgaattctggacttgccaggagataaccccaaggacgcacaggaagcccgtcatgtgcgacagattgcaagccgatacttgccgatggccgatctgattctgattgtcggcatattggacgatttaactttcctcaatccgaaggcattcgcacttccgggtatcagtgactggcgatatacgcccaaccgatttcgcgttgttaccacattctcgttcacgttggagtcagaaaaggagtgggccaaacgtcagcctgaaatgagtgtcgaccgggtacgcgcacatgtgttggagcagatcgcaacccacaaaatcgacctgggcagcagtgggagtaatgccaagctgtatttcccgctcgacttcggcgagtcgtggagaaagacccgtttgctcgaccctgaaaccttcacccgcatgaacgcgatcaacagtcagttgatggatgaattgatgttggatattgcggagtccgcgacggtccatgggcgccttcgacaagcggctgatagtcatattgtcgctttgcgggtaaagcaggaggaatcgcagaggatgcgcattctgctcgctcagcttgaggtgaggaaggtaaaagcccaacgcgtgcagagtgaggccagtcaccgcgtggccataaaaaagagccaaatcgctgaagcgcaggtaccggcgcttggtgttcaggagcagatgtatattctgaacaactgcagcaaaggcattactgattcagcggatgttttcgatgttgaggacatcgctactgataccggcgcgctacatggacgtatcgacaagtgctgttcctatttgcttgaagctgccaaggctttagaagcgcgcgcggttctgcctttcggtatccgtgtgcataaccctgtcgaacatgctcctagtgaattgcgcaaagcgctgaacaagtgttttgccgaattacgtgcaactttggacgcttacgtgttcgatgagtactttccgttgatttcagacgacttcgacaacgatagaacctggttgagcgaattgatggaagaggcccggtcgttggcgatccagtattcggctcggcaatggcgatcagcggtcgaaaccgttttgcaccagcgtaaagtgcagttggatcgagaacggcaggagttggcggtcctggagtcagtccttcgcgagtacgagcaaaggtatgaggatgctcgtacggagctgaaggcgtggaacaaaaaaattcgagacttcgaacgagatatggatattgaggccgaacgaggtgaacgattctctcgttatctgggtgctgcattcgatgaggagttggcgcaacgtcggcagatgataagtaatgaatcgtcgacacctcgcaagttgctccaactgctcagctgcaagcaattgtgtgacgagcgggataagttgatttgtggatgagtcacgccactttttccatccattccatttggcggtgacgcatgtctgaactcaataccgaagaactcgaattggccacgcttctgggccgtgtcatgtctgcacccctggcaccgttgcgcgagcatggcgcgaagcttgaaaaaggcttgagcaatgcagcgagtgagagcactaaatccagtctgttgatctcttccagtctggatagcatcagccagagccagaaaaagctcatgagcgtactggttgagctgaaagagcttcccgaacagcttcagcagcttgccagtcgtctggaaagcatgcgtgaagcggctgtaaccgtcgaacagatggagcagatgcagcggctgcttgagcgtcatgcgcgcgagcaacactcactgacggagcatggcctgaaaaacgcccaggaggcattttctcaacagcaacaaagcctggtggctctgaatgcacagatcaacctggccaatgatcaacaaagcctcctgttacaggagcagttcgagcgggctgatgcacacctgagtcaggtgttgaaggagcgtactcaggcactggaagagaagcagatagcgtgcgtgctgcgaatccagctgataggaagtcatctggtaaaactgcagaacacgtctctgactgctgatcaggtaacccggttgctggaagttcaggcgcgcactcaacaggagttgaacaaacaggagcacgagcaggttcaggccagtctccgtcagaacctgcaaggcgtgaccgagcttcaatcacgcttcaaacaggcaactaccgacgtgagcgcacaactgcaggagcagttggcccatgttgaactgaatcttgggctgcagctgcaatcgctcactcagcgtcatggccaacaattcggcagaaccttcaaatggatggttgcgctgggtgtattgaatctggtgggtttagtggcttgtatggtatgggttgttcttcaccattgaactaaccgcaagggccaatcgacactgtcatcgcgctatgctcttcaggcgtagctggcactttgccttatgtgcaggcatgctctcgactcattgtcagtggcgatagtcgtgccagggagagcaggtgtgggcttagagaagaaagccaaagcagcgcaattgagcgtcttgaaaaaatacggtgtcctggcagatttttccgacctcgaagaagtcacacttgatcgcatgctgaagggacgattggctgccgcaacagcgcaggagctgacgttcgctaactggtgcgaacaggtgctgggacaaggtcgccgggtgccgattgctcgctttgatcatcaggttgccgggcagacacggcttggcaatctcgcggtgttacgtgatctcgccggtagcctcaaggctcacgacagaaaggctcaaacccaactcaaggcgtctgagcaagaagtcgcccgattgaaggccgaactgaacgcccttcgacaatccaagactcgtgcggcagtattcgctccgttgtctgatacagcagaagcgttgcaatactggtattacgaaacgacggcccccttgcatcggatactgtgggagatcaaggaaattgaaggggggatcttcgataaccaaggccagttcaacagagattatcgtcagcaactggtcgagattatcctgtgtgcacttagtagtctggagtcactcggcttttgcgttgaggctgagttacgcgatgcctcccctaaagaaccggtgttcccaaccgtggtactgcatcgcagtcattcaactgagggcgcagacttcggcgttgaggggtttgcattcgaagtcaaagatattcagccggatgtgcttgtggcggcaagtgagaggcttttccttcgtcgcgatttgccagaaatcgataaacgacaccgcttcaattgtcacgtcaaagtttctgtcagcccaaggcttgctcacagcgaggacgagctgtttcatctttcttgctttatatacaaattgtttgaggccatggccaggtctggtgatagccggccgaggggaacgttgcgcgaaaaagtgattctttgcctgattttgtcgagcacggcgccatgcatgcccgctcgattgaaagggctggaaatgctgcggctgcaagacacgttttacaagggacatgagcccattgcatgggacagttcgaaggctgatgcggatgtttcagccgggaaaattgttgagcactttttccgtacgctgcatgcgaacgtttcgaggtgaaaggcctacggcagccggccagtaagtgttggacggaccgagtaagtacccatgaagcgccaacggggccacagatttgagccttgataatattcccaagagaacgagatccatggtgcaagacctgaaagatgacgcaaagctcaagattgcttgcgaaagcgttctcgatatctatcgtcaacaacctggctaccagaaatggacggcggctttgactggcttcttgcaaaaagtccataacgtggaacgagaagagttcctcactgaggatttccagcaggagctgtgggacagtgtggcggtctccgcgacaggcatgggaaatgtcgatgtttccgcgcttacccgagactcttcgatcgctgagtctctatggaaactgaagcagggctacttgacgtcttctgatgaaatgcgacacggattgatcgacagcacttcgtattgggtactgtctcaaattgaatccaaattaaagcgccggccacttttgaagttatgccgcgtttttgcagcgctttgtccaggtgatttcacaaccatcactaactttcgaaagcttcacgaactggccgtgcagatggggtacgagggcacgttcggacaaggtttgattgagcagcgatgggtgagggctcgattgaatcaaatcctcggaaatgtccgcgaggaattttcgcagccctggatcgagcgaatgaccttgccgtggttgttgtacgtggtttatgtgcaaaaaatggaggtggaaccaacggagacgatagatttaaccaccggggaggagaaactcattccgctttcggctgatcgccgccgccggggcatgttggcaataggtgggtctacttcgactatcagaaccatgatcgagttcgcgaaagacggctgctcacgagaggactttcgtgaacacctgcactccatcaatccgtctcatgccaccacaaccctaagcacacaattgaatgccctgattgcggaatggggagtgttgcgtgccgaaggcgacaacctgcagttgacagccagaggtgaaagttttctggagtccggagacaccgatgagttctgcgattggttactcactcgaattctgggtttcgacaacgcaatttatctcttgaggcagtcgcctataagcgtcaaggcgatgatctttgagctacaaaaagttaattcaggatggaccagcacatttgttcccaattgcttgatcacatggttgcgcagtttaaccctagtagaactgacgaaagaaaaaaccttgcagctcacagaaaaaggacagcgttgggcggcgagagtcgattggatacccggtgtattggtggccgatgcatctattgaaccggcgaacgctgaactccagagtcgtggatctatcaatcgtttggaactggcacagattgtcaatagttttgaccctctcattgctttcagaccggaagtcgtcgggcaactggatgccggtctctggagtcaccaccgtcgtcattttgcggtattgaccggtttgagcggtgcgggcaaaacagtgcttgcccgcagttatgcgctgggcctgtggcagcaggaacccgtaccccatgaaggcctgattaccgttgctgtgcaacccggttggcacgacccctcttgtttgctggggtatgtcaatccactgaacagcgatgtctacgtacgcacagcttttctggattttcttttgcgggcgaccgtggacccggatcgagcttatacagttatccttgatgagatgaacctgtcgcacccggaacagtatctggcgccgctcttgtctgctatggaaacaggggatgcgatcgagttgcatgctcagggcagtgaaattaatggtgttccagccagcattccttaccccggtaatttgttcattattggcaccgtcaatatggatgagactacacacggtttgagcgacaaggtactggatcgcgcttgtgtgatcgaattttgggacatagatgtcgacagctaccctgcctggaaagactgcaaactttccagcgagaaaatcgaaaggattcaagttttgctcaaagagttggtagcagcgttgcgccccgtacgactgcattttggctggcgtacgattggagatgtactcggttatgttcgcgaggcgctgcgcggaaacatcattgaattcgaaaacgcactggatcaatccatctactccaaagtccttccaaaactgcgtggggaagatacgccgcgcttgcaaaatgcgttcacaaaagtgagagcagtacttcaggagcataaaatggtgcaatcggaagccaaggttgccgagttattggatgacttgaaattctcaggctctgcccggttttggcgttgaatcgtggctgttatcgaatgcgttgaaaagtcaggtcagacattcacgatgtatcctgatcagctttgttccggcttcaatgagcaaggctgctactttttttcggtcccggtggagcgcgggcaactgtacatcgacgatgttcaactatcagttgtgattcatgacggacgcagagcttggatttgggaaacaggcttttatgccggcgaggtcaccgctgaactcaccgacccctatggcaagaccatcgctctctaccgattgggtgttgtgccgcaactcggaaaactcgagcaagcatcgttcgagcacatggtcgacgacattctgaagttcgatgcgcgattattgatgggaacggagttcgctcaaagcgcggtaggtgtggaaggtgatgtaagcaatctgcaccttcaatacgcgcgtctgcggcgccatagcatgcaaatgctaatggcaatgcacggtgtcgcgcgaaaccctgtctcggcgcggcgaaatgaacgctcacttcaaacgctgaatcgggtcaagcgccttgatcgcatctcgctgctcaaagcggcacgcaatcccgcagcgctttgcgtcatcgcacgcaatacatgtgaggagggcgcaggaaacccgatcatgtttgatgtttcaacgacattcagtaacctcgataacccggcgaatcagacactttgcttgatgctaaaaggcgtgattcgccgtaccggacaagtcattgacgctctgattgaacgcgctgggcagaaagacttgacaggggcgcgttcggcgctgattccgcggctcaatcgtcggatcgggtttctacagaatctgcataatgatttgcggcgcattctgcgtagagaaccttttgcatcgctgaaggtggccaaagtatcggcagcgggactgaacgtcatttccgcgcatccagactatgcacgagcttatcgttttggttggtatatcttgcgtgcagggattcacagtgagctaaccgaagagcgactttggatgagtccgacctgggaggtttacgagcgatggtgctatttgaaagtggtcgaagggatgcgtcagcgttactcattcctgaatgaaaaattcactacaccgacgtctagtatcgactgcatccggtttactgggaatgcacccgatgtagagctcaatatctggttacaggctcgttgtcccgcattggatcagccgtccaatcaagggttttccagcatttccaaattacgcgttcccgacatcgcgattaccctggatgcccatggaaagaagcgtttcttgattttggatgcaaagtatcgaacgagtcgtgatggagtgctggatgcaatgcagtccgctcatatttaccgcgacagtttgcgttggttcgggcaccgtcccgactgcgcattgttgttagtacctcagaaaggcggggtggtggcacttgagtcgaaggagtaccagtccacgcacggggtcggtgtacttgggttaaatgttactgagggtattgatgaggtttgccacgttattgcagagtttttgtcgattgaatgggaatagagatttttgattctttcaaatctcgggcggtaaatgtccccgccatgacgccggttttctgtccagcctgttaacctcatacaggcttctattctcggatgagatgaactctccgggcttgcaccgatgatggagcaccactcacgccccctggcggcttctgattaattcataagcccggcgcaccatcgggttcacggtgttggggcggatccacaggtaataggtcacgtccggcaaccgtggcagcccgtcggtttcacccagtacgcgcatgtccggcccgagcatttccatactccgcgccgtgacgccaaggcctgcgcgtgttgccgctttgatgccgatcagattggacgccagatacgcctgacgccatgggatgttcgcgcgttccagcgcttccagtgcgtagcgtcgatagatgctcggctcatccaccagaatcaacggcaggggttcgccggggttatggatgtactgcgccgagcagatccaccacactggcgaagtgcgcagggcgaagccttcgaggctggcgtcctggcgggtggaaatgaccatgtcgatcttgccgcggtgcaaatcttccatcagaaacggactgcgaccgacgtcgatctcaagccgcaggcgcggggccgagcgggcgatatggctgagcatcggcggcaggatggtatcggcgatgtcgtgaggcgagccgatgcgcaatacgccgctcagagtgctttcgcgcagaccattgagtgcctcgtcgttgagcaaaagcatttgccgcgcattgcgcaacaactgcaatccagcctcggtgagttgtttttgccgcccgcgcttctcgaacagactcacgccgaccagttgctccagccgctgcatgtgctgggtgaccgacgactgcgtgcgcgccagttgagcaccggcctcggcaaaactgtggtgatccacaacagcaataaaggtgcgcagcaattcgaggtcgagggtagatgaggtcgacatggccattcctgttggctgttttatatcaatacggcaacgctaaacattacagatattgatgtgtttctgtcgatggcttgagttgatcgatccgaattcccagtaaacgctaggcttaaaggcttatgccaaaaatcgcaatacgccgagttataacgatattagatatttgaatttccgttacacccgcgcgctacataggatgccctcacacagatcggggtacgccgatcaaccatctgggggaagttcatgttgctcaagcgcacgcctgttaaacaatggttgcccgtggtactgggcgctctgatcgcgttggccggaactgcgactgcccatgccgatgcgacgctggacaagatcgagcagcgtcatcagttggtggtcggcgtgttgctgtccggtggcccgttcggcggggttgatcccaccacgcagaaaccgcgcggcctgaacgttgaactcgcgcaggagttgggccgtcgcctcggcgctgaagtgcaactggtgccggtgctgcctgccaaccgcgtgcagtttctccagcaaggcaaagtcgatttgctgattgccaacatggagtggaccgccgagcgcggcgagatcctcggcttcgtaccgacgccgttctatcgcgtcggtggcaccgccgctgtactcaaggacagcaagatcacccgctgggaagatctgaaaaaccaggcagtctgcacctcgcagggcagcagttacgtcaagccgctgaccgatttgggcgtggagatcaaagccttcaagagttcgtcggaatcgttgctcgccctgcgtggcaacaactgcgtcgcggcggtgcatgacgccacgctgatcaatccgctgctggctgactccgccgaatggcagggctatcgagcgatcagtccggaactcaacccggcgccgtcggtgatctggacccgtcgcggcgaaagcgacactcaggccaggctcgatccgatcattcaagacctgcatcgcagcggctggctgattgaagcccagacccgcaaccacatcacccccgcatcacctgcgctggtggaactgcaacagcagtttcaagccaacggcgcctgatcgcccacgttttccacggtccatcgtgctgcgcgatggccttgcaaggtagtcgtgcatgaaccgtcattttttcgcaagaaatctgctcaccctgtgcctggccgggtgtgctggtatggtcgccagcctcgcccaggccgatgcgacgctggacaagatcgagcaacgccacgccatcagcgtcggggtgattctcagtggcccgccgttcggtacgatcgagccgaaaaccggcgagcacctgggctataacgtcgaactggccaagggcattgccaaggcgctgggcgtcgaagccaaaaccgtctcggtgctggcacccaatcgcgtgcagttcttgcagcagggcaaggtcgacatcctgattgccaacatgcagttcaccgaagagcgcgccgagattctcgattacgtgcccacgccttacgaggaagtcggtggcgcggcattgattcgaaagggcgcgggcatcagccaatgggccgatctcaagggcaaaccggtgtgcgtgtcgcagggcagcaacttcatcaagcctttgcaggaaacctacggtgccgagatcaaggcgttccgcagtcagtcggagtcgctgctgtcgctgcgcggcaatggttgtgtggcagcggtgcatgtcagcccgaccatgcacgcattattaagcgatgccgagtggtccggttatgaaacgccgctgccgggcgatctgattccgtccaactcagtgatctggctacgcaagggcgagcacgatacccaggcgaaactcgatgccatcgtccgtgactggcaccgcagtggctggctgatcgaactcggcgagcgcaccggcatggcaccgtcgcaggccttgcgtgatttgcacgagcagtaccgcaatgcggcgccgttggcggcgcaaccatgagccgggctttgttcgatgagttgcagcaactgctcggcgccaaccatgtccagagcagcgcagacgcggcggcgtacctgactgataaacagggccgttatgtcgggcaagtcattgccgctgtacacccggcaagtaccgaggaagtcgcggcggtagtgcgtgcctgcgtggcacgggacacccccatcgtggtgcagggcggtaacactggtctgatgggcggcgccaccccggacgccagcggtcacgccgttctgttactgcttgatcgcctgaatcgggtgcgctcggtggacactgataacgacaccctgaccgtcgagagcggctgcattctacaaaacgttcaggacgttgcccgtcaggccggacgcttgttcccactgagtctgggcgccgaaggcagttgcacgattggcggcaatctgggcaccaatgccggcggcactgccgtgttgcgctacggcaatacccgcgaactgacactgggcctggaagtggtgaccgctgatggcgaaatctggaacggtctgcgcggtttgcgcaaggacaataccggttacgacctgcgcgatctgtttattggcagcgaaggcacactcggcattatcaccgcggcgacgctgaagctgtttccgttacccaaggcgcaagccacggcgttgctggccttcgactccctcgctcaagcggtggcattcctttcccatgcacgcgctggtttcggtgccagcctcacggcgttcgagctgctcagcgccgagtgtctggcgttgttgcgcgagcagtttcccgaagggccgcaaccgtttctcggcgtcagtctgccgtggttcgccttgctcgaactgtcggataaccacagcgaaagccatgcgcgcgaagcgtttgaagaggtgctcggcgaagcgttcgaaaacagcttgctcgccaacgcattgatcgccgaaagcctcgctcagagccaagcgctatggctgctgcgggaaaacatgagcgaggcgcagaagcgcgccggacgcaacatcaagcacgacatttcggtgcctatttcgcaaatcgtggcgtttgttgcgcacaccgatgcgttgttgcaaacgcattttcccggcgtgcgtcatttcaccttcggtcatttgggcgacggcaacctgcattacaacgtggcgcatccgctggattcgaccgtcgaggcgcacatggccaactacgccgcattgagcgaacgggtccacgacagcgcccatgcccacggcggttcgatcagcgccgaacacggtatcggtcagcgcaaacgggacatgcttgaacgctataaaagcccggtcgagctgaaactgatgcggcggatcaagcaggcgctggacccgaaaaacctgctcaatcccggtaaggttgtcgaggtgattgcgccatgaacctgcgcctgtcccgacgtgtgcaacgcgtctcgctgtcggccaatgccgccgccaaatcccgcgcgactgaattgcgtgacgcaggtcgcgacattctcgacctgaccaccggcgagccggatttcgacacccccgaacacatcaagcaagccgcgtatgcagccatcgctgccggggcgaccaagtacacgccaaccccaggcgtgaaagccttgcgcctggcggtgcagcgcaaactgcaacgagaaaaccgtctcgactatccgctggccggcatcgtgattgccaacggcgccaagcagatcatcttcaacgcgttcgccgcgaccctggatgacggcgatgaagtactggtgccgacgccgtactggccgtcgtttcccgacagcgtgcggttcaatggtggcgagccggtgtttatcgagtgcggacttaagcagggctgcaagctcagcgccgaacaactgcaacagcacatcggcgaacggacccgctggctgatcctcaacggccccggcaatccgagtggcgcggtgtacagcgtggctgaactgcaagcgatcgccgccgttctgcgccgtcacccgcaggtgctgatcctgttggatgaactctacgagcacattcgctttgacggacaaccggcacagagcctgctcaatgtggcgcccgatctgcaagcgcgttgtctgctggtcggcggcgtctcgaaaacctacgcgatgaccggttggcgcatcggtttcggcgccggcccgcaagtgctgaccgaggccatgacggtcgtgcagtcgcaatcgacttccggtgcgtcctcggtggggcaagccgccgcactggcagcgttcgacggcggcctggatttcttgccggaacagctggcggcttatcactggcgtcgggatttgctggtgaacgccttgcgcgatatcgacggtctggaagtgcttgagccgcagggcggcttctttgtgtttgtccgctgcgccggtctgctcgggcgttatcgcccggacggagtgcgcctgaacaatgacgcggatgtcgtcgtgtatttactggatgagggtgtcgcggctgtggcgggcagtgcttatggcttgtcgccgtggtttcgcctgtcaatcgccaccgcgaccgacagcgtggctgaagccgggcggcgcatcgctcatgcctgccgacaattgcggggtgcagcatgaatcactggctggaaatgttcgtccactggaccgccggtttcggtctcaattacagctttctgctcgacgcctatcagcgcggaacgttggcacagggcgcattgaccacggtgtcgctgtgcctgttgaccatcgttggcagcttgcttgccggtgtcggcctggcggcaatgctgacctcaggcaaaccgtggctggccagaccggcgcgggtatttgtcgaagtcacccgcaacacaccgacgctggtgcagttgtattgcgcattcctggtgctgaacatgttgttgacccaggccgtcggcgcagcgaatccgctgacgccgttcgcctgggtggtgatcgtgatctcactgcacaaaggcgcctttcatgccgaggcgttgcgcgccggcattgaggccgtgccagcggtgacgctggaggctgccagctctctggcgttcaacagccgccagttgttgtggaacgtgcaactgccgttggctctgcgttttgccttgccatcactgatcaacaacctgatcgatctggtgaagatgaccgccgtggcctcggcgattgccgtcggcgacatcacctacgcggcaatcatgatctggacccagagcgacaacgtgctggaactgatgattttgatcctgagctttttcggcctgctgagttttaccgtcaattgtatggggcgctacctcgaagcgcgcctgaggattcccggctatggccattgaatcatccgttgccgcgccgctgacctggccgcgccgacacctaggcaagttgctgctggcggccggcatggtgctctggctggtctgcttcaccccacaaagtccagtgctcaaagcgctgctgcaatggtcgccggcgctggccgcaggctttgcgcagaacattctgatcagtctggtcgcgatcggcctggggtcgctgctggggttgctggtgggcgctctggccttgtcgcctttgcgcttgctgcgtctgccggcgcgaatctgggtgcagattttccgcaatgcaccttggctggtgttgatctacttcaccacttacgtgtttccgttcgagatccacatcggcagcacgtatgtgtcgttcccggactgggtcaaggtgaccatcggcctggccttgccagccagcgccaacgttgcggaaatcttccgcggtgcgattgcttcgatccccagcacccagtgggaagccgcgcgttcgctggcctttagccgcgggcagatcttttgctcgatcatcctgccgcaatgcttcaagcgcatgttgccgccgtggatgaacctgtatgccgtcatcaccatgggcaccgcgctggcctcactggttggcgtacacgacgtgatcgataccgcgcaaatcgccagcaacacggtaaacatgaccggttttaccgtggtgatttacctgagtctgctggcgttgttcttcgcctattgctacccgatttcccgtcttacccaacacctggagcgacgttatgccttctattgaaaccgtcgccgagcctctgatcagcctgcgcaatctgcacctgtcgttcggcagcaacccggtgctcaagggcatcgacctggatgtgcatcgtggtcaggcggtgtcgatcatcggcccgtctggctccggcaaatcgaccattttgcgctgcatcagcggtctgctgcagccacagcgcggcacgatccgcgtgggcaacaccgaggtgcacacattggctcaggaggcccagcgcatcgaattgcgcaaacgggtcgggtttgtctttcagcagtacaacctgtttccgcacttgtcggtgctggagaacctggtgatcgcgccgcgcaaagtcctcggccgcagccggatcgaggcggaaaaagaggcgcgtgccttgctcgccaaagtatgtatggagcacaaggccgatgcatttcccgggcaactttccggtggtcagcagcagcgcgtggcgatcgcccgggcgttggcgatgcgcccggaactgattctgttcgatgaagtgacctcggccctcgacccggaaaccgttggtgaagtgttgacggtgattcgtgagctgaccgaagagggcatgacctgcgtgctggtgacccacgagatgcgtttcgccgaggaaatcagcgacatcgtctacttcaccgaaaacggcgtgatcgtcgaacacggcagcgccgcgaagatttttcaacacccggacagcgagcgcacgcaaacctttttgcgccatgccttgggcgatccggggcgccgtcctgtcgtcgccaatgacccctatctgctgaccaatctgggtcgctacagcctgtccgtctgacaccgaggagcctgttcatgagtatcgaaaaccgtgccgccgtcattgaggattttctgcagaaaatccgtgtgatcaatcaacgtggcgtcgaccgcgctgccctggcagaaattgttgtcctgctcgaagaccttgccgaacggcgtgatctgttcaacttcgaggcatttcccgcgccggtgccggggcagggcagcacggcgtttcgctaccgtctgaatgacgatggcgacacaccgacgctgtatctgaactcgttattgccaggcaagagcaccatcccccacaaccacgaaacctgggcgatcatcagcgccgtcgaaggcgaggaaatcaattacgtttaccgtcgcgatgacgaaggccgcgaaccggggttcaccacgttgcacttgcaagaggaagtgatcgtgcagcccggcacctcaatcgcgtttctcggtgaagacctgcatggcattcgtgtcgaaggcaagcaggccaccctgcatttccacctctacggtttgccgctggagtcgctgaacggccgttatggcgttgaagccgacgggcgcattctcaattacaacgcctcgcaaatggcgccgtcgatcaaggcctacgaatgatcgacatcgcggtcaatcagcgctcgctggcgcttcaataatttcctttttagcggaactcccatgagccagaccgtcaccccggagcaattgcagcaatggctgttcgatggacaggaaatcgccctgttcgatgtgcgcgagcatggccagtatggcgaagctcacttgtttttcggggtcaatctgccctatagccgattggaactggaggtcgggcgtctggcgcctaaccctcaggtgcggctggtgatttatgaccagaatggcggggatgtggcggcacgttgcgctcagattctgcaaacgcggggctacagccgcgtgcacgtgctcgtcgggggtgccaacggctggcaggcggctggttatcaattgtttgccggtgtgcatgtgccgtccaaggcgttcggcgaattggtcgaggaggccgcgcatacgccgcatgtcaccgctacgcagttggccgaatggcaggcgcggggtgagccgctggtggtgctggacgggcggccgttcgacgaataccgcaagatgaccattcccggttcggtctgctgcccgaatggtgagctgggttatcgcgttcaggatctggtgtcggacgacagcacgccgatcgtggtcaactgcgccggccggacccgcagcatcatcggcgcccagaccttgatcaatctgggcgtaaagaacccggtttacgcgctggagaacggcacgcaaggctggtacctcgaagacttccagctggagtacggcagcacacggcgctacgccgatgcggtgtctgcgcagaccttgccacaacaacgtctcgccgccacgcgagtggccgagcaggccagcgtgaaaacggtggtcgctgcgcaggttcggcaatgggcgaaggagggcgcacgcagtctgtttctctgtgatgtgcgcacggctgaggaatttgccgctggcagcctgccgggtgcgcaacacaccccgggtgggcagttgattcaatcgacggatctgtacatcggcgtgcgtcaggcgcggttggtgttgcttgacagcgatggtgtgcgcgcgccgattgtcgccagttggctgcgacaactgggccatgaggcgtatgtgctggcaggcggggtcaacagtgatctggcgttgccggtgcatgaggctccgactcattcggcgttgcccctcatcactgcgcagtcgctgaatgatgcgctgaaggatgatgcggtagcgctggtagacctgcgcccgagcatgagctatcgcaaggcccatattgccggctcgcgctggtcaatccgctcgctgttcgccaatgacctcgctggcgagcagcgacctctggtgttggtggccgacgactcacgcctggccgctttcgccgcgcaggcgctgacggccgaacagcgtgagcacgtgcgcctgttggagggcggtctcgctgcctggcgcgcggctggattcgccgtgcaggaggacgccaatgcgccgcccgatgagcaatgcatcgactttctgtttttcacccacgatcggcactccggcaacaaagacgccgcccgccagtatctggcttgggaaatcggcttgttggcgcagatgagcgcggatgaaatcgccagtctcaaacccctgcgtgtgcaagccgattggcgagtccgcacgcaccttgtgcaagccgggcgaagcgcaaagggcagtggtgcccggggtgtcaacgtaccggtcagtcgcttgagcacggtgctgttcgacaatctggcgcaaatgcgcgacgcccgtgctcgccgagacaaagaacgcgtgctgagctacggcgcccgaggcaatccgacggcgttcgctatggaagatctggtcaccgaactggagggcggttaccgcacccgtctgttcggcaccgggctggccgctgtcgcccaaacctttctgacctacctgcgccccggcgatcacctgctgatcactgatgcggtgtacgcgccggtgcgacgtctggcccgcgaactgcttgagccgttcggcatccaggtcaactacttcgcccccgacggcagcgacctggcggcgcaactgctgccccagacgaaaatggtctacaccgaagtccccggctcattgctctatgaactcgccgacctgccagccatcgccgcgctgtgcaaaccacgaggcatcctgctggccgtcgacaacacttggggttcgggctacctgtatcgaccgctgaaactgggcgcagatatctcgatcatggcgctgaccaagtatctgtgcgggcacagcgatgtggtcatgggcagcgtctgcacactgcaggaggtctggcagccgttggcgtcgatgagcgacacctttggcatcaccgtcagcccggacgatgcctatctggtgctgcgcggtgcgcgaaccttggcgccaaggctggaagtgcacgagcgtcaggcgttggagattgcctattggctgcaggatcagccgcaggtgaagcgcgtgtttcacccggcgctgtctgaacatccgtggcatgaactgtggaaacgcgatttcagcggcagtaatggcttgttgtcctttgagttgcgcgctgccgatgtggacggcgtcgagcgctttattgatgcgttgcaggtgttcggactaggggcttcgtggggtgggtatgaaagcctgattaccgtggcggatacccaagatcgcgttggtgcagccgagcgcttgctcaatccggtgctgaggttgcatgtcgggctggaggatgttgccgcgctgatcgaggatttgcggcgggggtttgcggcgttgggataatcccgaaaggacagaatcaccctgagtcatgacgcaaaagagcatatggatatgcaattttagtctttgattcctaaagggtttgccgctcaactggcgccttttgataggaagctattgatgtccgagcgatgtgaggtggtggttctgggcttgggtgccatgggcgcggccacggtttatcagttggcgaaagcgggggtgaatgtcgtcggcatcgaccgccatcacccgccgcacaacctcggctccagccatggcgacacgcgcatcactcggctgtcggtcggcgagggcgcgcaatatgtgcccattgtgcgcaattctcatcgcatctggcgtgaacttgaggcgctgaccggcgagtctttgttcgagcaatcgggcctgttggtgctgacgtcgagcgccgagttcgatcctgaagatccatccgacttcaccttgcgcaccatcggcctggcgcagacttacggcatcgagcacgaagtcctgtccgccgaacagatccgccaacgcttcccgcaattcgccaacgtgcacgactcggccatcggctatttcgaaccgggtggcggctttgtgcgcccggagcgctgcatcgatgtgcagctcaaactggccgagcaacacggtgcgacgctctacaaaggcgagaccgtcaccgggatcagctcgaacgaggagggtgtcacggtcaccactgaccggcgcacgctgtttgccaacaaactggtgatcagcgcgggcaactggaacggcgagtggctcggtgagccgtatgagagcctgctgagtgtttaccggcaaaagctgttctggttcgagctggaagagaacgcgggattggtcggccactcaccgacgttcatcttcacccacggccgcggcgacgacaaaatcaactacggctttcccgcgctacccggcgaaagcagcatgaaaatcgccaccgcgcagtaccacacctcaacttccgcgcaggccatcgaccgtacggtttcaacagccgaagcgcaggacatgtatgagcaccaggtgcacaaccgcatcgctggcgtgaccgcgaaagtcgtcaagtccgccgtctgtgcctacaccgtgaccccggatcgccatttcatcatcgacgagcatccgtcgctgcaacacaccctgttcgtctcggcctgctccgggcacggcttcaagcattccgccgcgctcggcgaagcatttgcgcagtggtgcatgcgcggctcgagcgacctggatctgacctctttctccctgaaacgcttcgaaggaaaactatcgtgaaacgcgtcgcgctctccgtagcactgctggtcgccgccatgggcaatgcctatgccgaaaccctgaaaatcgccgtggtgcctgtgccccatgccgagattctggagttcttgaagccggaactggccaaggaaggggtgacgctggatgtcaaagtcttctcggactacatccagcccgaccggcagactgatgaaggcttgctcgacgccaattacttccagagcaaaccgtattacgaggcctacaaaaaagaccgcccgagcagcgatcaagtgccgatcgtggccgtgcacatcgaaccattcggtgcctattcgaagaagatcaaaaacatcagcgaactcaaggatggcgcgacgatcgccattcccaacgatccgaccaactccggccgtgcgctgctgctgatcgccaaacaaggcctgatcaccctgaaggatcccgacaacatcatggccacgcgcctggacatcgtcagcaaccccaagcatctgaagtttcaggaactcgaagcggcgatgttgccgcgggttttgaatcaggtcgacatggcgttgatcaacgccaactacgcgctggaagccaaactggtgccgcacaaagacgcgctgtttatcgaaagttcggagtcgccatacgccaattacctgtacgtgcgtcgcgacaaggccaatgcgccggcggtgcagaaactgggtgcgctgctcaattcaccgcaagtgaagcagttcattcttgagcgttatcacggcgacgtggtgccggcgttctgactccgtcgggagccgccagacatgctgacggctcccgacatcttcaagcgttctcttcaatccggcgcacgtcacccaaagagtcacgctgcattgactgcaggttcttctcgatggtttcgcacaacgcttccatctgaatctggtgttcgctgtggcgaaacgggctttgcagatcagtgccgatacgctcgatggccagcagcataaaacccaccacggtcgaggccagcggcgtgaaccatcccagtgactcgaccagaccgatcggcacaatcaggcagaacagcgaaataaacagtcgtgggaaatacacataagggtagggcagcggcgtattggcaatccgctccatgccgccctggctgttggagagatctaccagtgtcgattcaagccgcgccaggcgaatgctgtccaggcgcccggccttgtattcccgcgcgagcaaagtcgccgagccggtgaggatatcgttggcaaagttattggtcgtgccactgcgggcgaactcgtcagccggaatgaacgcgcgaacttcctcagggcaaggctggccttgcagatgcgccgcgaggcaattcacataggcgacgtggcggcgtaacagggtcgatttgaccggattgacctcgccatcgggatcatccagcagcgtcagcacctggcgggcgaagctgcgcgaattgttgatcatcgaaccccacagcgtgcgtgcttcccaccagcggttgtaagcgctgctgttgcgaaaactgatcagcacgatcaatgcggaacccaacaacgtcaggggcatcaatggcagattcagcttggcgttgaggaacagcatgaagtcgacggtgacggcgatgtcccagagcagcagccagaacaacgcccagccgacatagcccagagtcttgatgatcaaacggtattttctgacgatggcagctttcaaacggaaacctcgtggtgagcggtaagcgttaacgccttgactcggacgctgttttcgcgggaaaggttcgctaaatcgcttcagctttcgtcgccacgggctaattagcccggagacgattgaaggaaaatgacagggaccttttcatcagtctggccatcggcgtttcgattttttcgtgaatgacataggacgcagcgatcatcaaagccacggtgccccacagcagcaggtgcgcattcaccgccggataggccatgttgaagatgatgaaaccgatcatttgatggagcaggtacagcgggtaagtcagggcgcctaatgttgtccagttcaatcgcccgatggcggctgttttgttggttgcgatcaacaggaaggtcatgaagaacacgattatcacgctgccgatgatcgagggatcgtattgcgttgcatatttgctttcgatcgactcggcccaggtaatggcggtgaaggtggccaaggccaatgcgcccgccaccagggcgatgcggggttttgtcataccctttgcccagatcaggtagaacgtcgcaccggcgataaagtaggccgcgtaatcggtgatcagtatcgagcgcagcttctcaaaagcgaggacttccgcggtggccgacaccagcagccagagcacgagacagagttcgattttgtctattttcttcaaggccaggagaatcgagatcatcaggtagaacttgatctctacaaacagtgaccaatacacgccgtcgatgggcgggactccgagcaggtcgccgaggaacgtcatgttgatcaggtattgataaagatctgcgctgaatcggggctgtccgaaggccagtgtgatcaggaacgtgagcgtgcagcacacccagaatgccgggcacaggcgcaccacgcgggagatgaaaaacacctgcagattgttgctcgaagcggtcatcaggatgacaaatccgctgatcatgaaaaacagttccacgcccaggtaaccgtacttggccacctcggccagcagcggatagggcatgaccgacatgtcgccccgcgcatagccgcgaaaggcgtagtgaaaaatcaccacggcgagcgctgcgaggaaacgcagcaaatccagctccttcagtcgtcggttgttcatgtatgggcgctccggaggtgttagcgctgatcgagaactgacgactctgccgagtgaaattcgactcaaggcgcaagctatggcagcaggagggcgtcgactgtccctggcttggtgtgacggttatggaccgcgttgccacatgcggatgtagtcgacctcaaaggtggacggcagatcagcgtcatcgaccacgccgaaccatttccacatggcctcactgtcaaagacgatttgcatcgggaagaagaagtggcggttcttcgattccctgaccagcacgccatcgacgtaccagcgcagggtgtcgggctgccagtcgaagccgtagacatgaaagtcactggccaggcgccaagggctgatccaggtgctgccgttggcgatatgttctttactttgcggcgtcgcccataggtgggcattcatattgtaagaacggtccgaggctgcgcctttggttttaccgccaatttcaaagatatcgatttcagtggcgttgtccgtgaagcccgtccacgccagccagaacgcgctcgacgctgcggagttcatcggtttggcgcgtgcttcgtagtaaccgtagaaaccgcgttcacgggtacggaccatggctgaggtgtaatccttgaagccaagctcgacgtacttctgcggcaaggtttccttgcgaaagacaatgttcaggttgccgttgctgacgctggcattgcgtggggtgaacagcgccggtttgcgcccgagcgattcgttgccgatggcattgttgacgtgccagcgcgcagggtcgagggtgttgccgttgaagtcgtcggacagcgtcgtgttgaatgcccagcgcccggcattggcctggtcggacagcggcagataggcatgctgatgcgtcggtactttgcccagtggaccgacgcgggtccaggtatcggcatggctggggacggccactgaccacttgtgcgcaaggtactggaaagcctgctgacgctcggcgagggacgcaaacgggcggtcgtaaaccagcacctcggcgatgtcgccgcgaaagttttctgaagtaccgacggcattgcgcccgaccgcatacgggccgatcggcacatcctgcagttccaggaccgacaccgtcggttcatacgcgctggtttgcgccaggctgatggcgaagttcggcaacacgttatcgttgtcagcggtttgcgcacgtgaactgaacaaccgctgccacggatcgaccccggcctgttcgggcaatcggcgggaaacgatcaacaccgtgacaggtccttttgcgctacgaatgcttttgcccagaaacgccgacccaccactgaaacgcacgaccgcatggccattcacggcattttccagacgttgcggctgctcggcaccttggtcgaccatcgcgtcatgggactgacctgatttatcgccccagcgttgcacacgattttgcgcgttgaggctaaggctggacgcatcagcggcgtccagccacagcaccagcccggcagtcggcggcgcttgtgcggcgctgccagtcagcgcaacccacagcagtagcgccggcagcgatcgtaagaacatcatttgagggcaagcagcgctggaatttcgaaggacgactgatatccctgtggattgcacgactgccagcgccaggcatcgacaatcatttgttgcaggtcgcgttgcgcggtccagcccagctcgcgtccggccttggccgggtcggcccagcacttggcaatgtcaccttcgcggcgcggtgcaaagcggtacggaatggagatgccggtgatgtcctcgaaactgtggatgatctgcagcacgctgtagccgacacccgtgccgaggttccagaaatggatgccgtggttgtgctgcaacaccagcagtgccttgaggtggccaatggcaaggtcgaccacgtggatgtagtcgcgcacgcaggtgccgtcgacggtgggatagtcgctgccgtacaccgtgagttccggtatccggccaatggcgacctgggtcaggcacggcagcaggttgttggggcggccgcgcgggtcttcgccgatcatcccgctttcgtgggcgccaatcggattgaagtagcgcaacaggccaatgctccagcgcggatcggactcgcacaaatccgtcagcaactcttcgatcatcagcttggtgcgaccatacggattgaccggtttaccggtgccgaagtcttcggcaatcggcgtacgggtcggctcgccgtacaccgtggccgatgagctgaacaccaggcggaagacgttgttgcgcgccatggcccggcacaggtccagcgtaccggcgacgttgttggcgtagtagtcgagcggtttgcgcacgctttcggcgacggatttgaggctggcaaaatgcaccacggcatcgatgtcgtaacgctggaagatgtcgtccagcagatcggaatcacggatgtcgcccttgatgaaatcgacccgggtcagggtcagttgctcaaggcgcgcgatgcactcctgacagctgttgcacaggttatcgagcaccagcacccggtgcccggcattgatgagcgccaaagcggtgtgcgagccgatgtaaccggccccgccagtaatcaacgtggttttgcgcatggtgaggtcttcctgtctcagggactgaatcagcgggcggtgaaaaccgatttgaattcctgcggccagtgcgggtggatgaggctatacgccacggcgtagctcaacgcgcccagcgcgatgttgccgatcaggtgcaggtagccttgaaagcccagttgcggtgacaccagcagcacggtcgcggccatgaccagcgcggcaatcacgctgcggtaattggcctcgacaaaccgtcgccagctgtaaccgatggccaggttgaggccgcggatctgcagcggcgtgatcagcagcatgcgcgtgagcagagcggcagctgcggccatgccgccataaacgttgccgaggctgtaaaccagcgccagcgccaggacggtcgtcagcacttccgccttgatcgtcaggtggctgcgattgaccgccaccagcgcggtggtggcgtacattgcggtgttgccgatggccgccgtgcaggccagcacttgcaacagaggaatggcgtcagcccacttggcgccgaagatcaacaggatgaggtcgttggccgtgagcgcgaggccaatgaacagcggcgtcaacacaaagccgctgaccgcggtcgagtcgccaatgatcccgagcaggcgcttgggttccgcactgcgtcgggcgaacgccggcagcgcataactcagcaggccgttataaatcgccgtgcgcggcagctcgatgatgcgcatcgccatgttgaacatgccgactgcgttcgccccggccgtcatccccagcaccacattgacgccgcgctgcaaggtttgtgaactgagtgaattgattgcaaccggtgcaccggccctcaacagttcgcgcaggaccgtccggtcgatggcaaacgcgatgcgtcgccggtctgcacccatcagaacaatgatcgacacccattccatgatcagcgcctgggcaatcaccgcccacgccccccctccgcacagcgccaccgcgatgccgccgacgccgcccgcgactttgcccagtaacgtgcgcgacgcgagcatcttgaagttgccgctacggcgcatttgcgccacatagacccgcgccatcatggtcaacaggattttcaccgaggccaccgccgtcagccattgcagcagcgggtcggacgtgtacaggaatgccgcgagcgagatgatgacaatcgataccaggctgacgagcaccccggcccagaaagccgtgcagatgtgtttgtcttccagccgttcaaggcgtaccagcggatcttccagcaccgatgagtacaccaggccaatcaattcgacgatggcgatgatgatcgtgcccacacccagctcggccggcgacagcagcttcgcgtagacgacaaaggtgatcatcgacagcaggatcaggccgaatttctcggtgaagatccagctcaatgtcaccagacggtgattggccatggcggttaccgattcaatgagctggagttgacgccgttgccttgcgccatgttctggcgcgggcatagagatagcgcaaggtcgctttgccgttggcgaagatcagcgcttgccaggaacactcgagcattcgccggtacacaccgagcacttggtcatgctcgccgcgacgggaaaacgcttcgagaaaatcggtgtggttgctcaggacgaaattgatccgttgctgctggctgagcatctcgccgtagcgggcgaggtacacctcaataaaatggatcttgttctggtagtacttcttcggttgcgcggtcatgttgccgccgttgaccgtgcgctccagcagtacttgcggcactgtgtggacctcccagtgttcggcgatccgcgtccacatgtagcggtcttcggagtaacgcaggctcgcatcgaagccaccgagttgcatgatcacttcgcgcctgaccagcgcagtggaaacgccattgacgacgttggcgtggatgaagtcgtagaagtgccggccgcttttgcgccggttgtccagttgccgccggccgtcgctgtaattgacctgcgcatagcagtcgatcaaccccaccggccggccctgacgactgagttcgtcatacagggccagttgcagttcgagcttttgcgggtgccactggtcatcggcatcgagcatcgccacaaacgtctcttgcgagtgccgcatgccgtgattacgcgcgctggcctggccttcgttggcttgctgcagcagcgtcaggcgaaacggcgcgacgaagtctctgacccgttgcgggccgtcatcggtggagccatcgtcaatgacgatgacgtgatccggcaggcgggtttgcccgaccagcgacgccaatgtctgctcgatgctgtcggcgccgttgtacatcgggatgacgacgcacactgaatccacggaaggggaggcttgattgggcacgggtggttctccttgggttacgcgttggctgaatcgcgcggcactgctctgccagacacacgctgacgctgcgctgccggtgaggttgcggggtaggccgcgaggtgatggcggaaagacagggccagggtgcagaacaccagaaactcggcggagcgatagttggggatcacgtacgccacataattggtgacggcgaacaagccgatgatcaccagcgcactggcgcgaaactgcgccgtctggttggcggtcacggcgcggtattgcttgagcagggcttcgccgaacatcagggccagcgcgcttagttggatgattccgccgttgagcagggtttcgacgtagccgctgtgggcgttaccgatataaccccagcgggtaatgaagccatcggcatcggggctggaccagaaggcgccgaagccgtaacccttgaggaactgcccgtcgataaacggcgcgagcagttcccagatcaaggtgcggtcggtcagtgacgggtcacgaccggccatttccagcagcaccgcgaagttgctgtagaggaacaggcacaccagtagatagaggagggtgcagccgaggaacatcagcggcgaatggttgatgcgcaaacggatcaaggtcaggaagtaccagtagctgatcgcgccagaaacaatcagcgccaccccggtcgccgactgcgcgagcaggatcgccaccagcgagaaaaacgcacagaacagcgcccagtgattgcgtcggcgaatcatcggtagcaataacaggatggcgatcgcgttgagccgggcaccggcattcttttcggcaaaaatccctttgaaggcgccgtcgcgaatcccaccggacaggaacgcgacatcaggcatgaccaccgccaggatcaagccgatcaacgccgccccgccgatggcgcagccgagcatgaaggtgattttttccagcgaatagttgtaggcaatgaaaccggcaaaaaacaccatgctgagcatcgcgataaagcgcttgaaactcagcatcgggtcgtgggaccagccgatcgaggcgatgacagaaaacatgaacagcaacaaaaagaagttgctgcgataaaaggtcttgctgaggaacaccttgttgcggatgaagaagaataacggcaccaacagcgtgatcagcccgcagatctgattggccacgttgccttcgaggtctttattgatatcaccgaagctggcggccccacccagaccaaggacaaaggtaatcacctggatgtagaacagcacgccgaacaaggtgaagccgtcgcgtaatgtcgaatacctgatcgccagtgtgctcatgatgacgggctcccgatcaacgctttgaggtaggtctgcaccgcgctggcattgatgaaccgggcggcggcctccaggcgcaagtgacgctggaaattgcgcggtgtggccagttgcagggtgatcgcctgcgccagggcgagtggatcgtcgacgttgaccagcggcgcgaccagaccgccgacgaggatgtcttgcgggccatgggggcaacgggttgccaccaccggcgtgcccgtggataacgcctctaccaatgcgttgggactgccttcgaagcgcgacgacagcacgaagcaatcagcggcggcgacctctgccaacggggcattggcatagcccggcagatcgaaacgctccgccacgcccagtgcgcgcgcctgctccagtagattgggcctgagtgcaccctcgccaaaaatgatcaggcgggcgcggctgtccggcaatgcagcgaacgcggtgatcaaggtgtcgaagcctttttgcggcgccagtcggcccacggcgacaatcaccgggccgggcttttccagcagccagcggtggctgggcaggcccggtgttttctcgcgaaagtcgttgtcgagcaccgggttatcggcaatggtcacgtcttgacggcgggcgacggtggtgtcgaccaggtcctgggcaacaccccgcgagacacagatcaccgggttgggaatcagccgatacaacagcggcgccagcaggtacgcgacgcgcaccatgaagtcggggttgacgtgcttgtcatgggaaaaggcattgcgctcgctgacgtgcaggcgtgccagcgtgccggacaacgccgccgccgcaatcgccaccacgttgacgtgggtaagggctgccagttgtgcgtcaaagcgattggcccgcagaaatcgcgtaagagccggcactgcacggacgctgcgcggactattcaactcaaccttcttcacgcgcgggtcgaggtgcgcggcgtgaatgccgccgccggtgagcattaacaaggtcacgtcattgcccgcgtccaccagcgctccggccaggcgcgccatcattttttcagccccgccggcgctgaggtcatgcaggataatcagcagctttttcattgattccatacctggtaatacgcctgcgccgcgtactggctggtgtactgacgcagggtgtcagtgagcctggtttcgctaaaggcgacgtcatcgcgtggggtcaggctgcgcagcatgccggcggccagcgccggtacgtcgtttaccctcaccagttggccaagtcggccgttgtccagcagttctctggggccggtctcgcaatcgctggccagcaccggcgtgcccagagccagcgcctcgatcaacaccgtcggcatgccttcttgcacggaactcaaaatgaacagtcgggcgtgccggagcagcggataggggttgctcaggaatccggtgaaatgcacccgcggggcaatgcccagacggcgggcctgagccgtcagtgcctcgcgcaacgggccatcgccgacgatcaccagatccggcagcgctgcactgcgcagtgccagtgcgtaagcctcgagtaacagctgaaaacctttcggttcgaccaagcggcccagacccaaccagtaagtgccgggcaatccgccgggtagcggcgcctgcgaggcttgaaacagctgatcggtgaccaccgcattggggcaataccggatgcgctgctgaccccagggcagcagctcgataagcgtctgacgcaaggcattggaaacagtgacgaccttgccgctgccgcacaggtacaagctgtagagcacgcgcaggctggcggggccggtgttctgttcactgcaatcaagggtcgcgtggcggcaatagatgactttgcagacatggcccaaggtggcgaaccaagtgcagaggttggcctgctccttggcggcaatcaggtgggtgacgccttcgcgctgtatgagccggcgcaacaaaacgatggacttgagcaaaccgacgagaccgctgccgccaccgttgaagcgctgcacatcgggggtgtcgggcacgtctgcgttgataacgaaaaaactcacccggcggccgtccttgagaaactgctcggacaagcgttgctgaacgcgctcgacgccaccgcccagcttgaaatccttgagaataaagaggatgtgcatggtcattcccccacactgatggcgactttgtgccgggcgagcattgtcagcaggtgcaagaagttgctggggtaatcgatgaggtagcgtttgatcgtatgcggctcgcggtacattcgataaaacgcgcgcaggtgcaggcgattgatcagcgccgggtagtattgccgcgtggccaaggcttcctgacggatgaaaccgccacaggtgaaggcaacgccgcgaaagcctgcgcgcagggcgtcctgttcgaactgttcttgcagcccggcgcccaggccaacaatgagaatgtcggcggcgctgcgacagatgtccgcttgaatgtcttcggcctcggcagcgtcgaaatagccgttgtgataaccggcgatggtcaactgcggataaagcgccccgatcttgacgatgaacagctccagttcggcctgccgggcaccgacgaagtacacgcgcttgcccagttgctcggcgctgccgaggacaaggtcagcgatcgaggtgaagtcaaagctgacccggccaatcgtcctgccggtgacgcgcgacatgaaggtcgacatcagcatgccgtcgcagaaataggcgacgctgcttggggtctgcgcgaaaacgctgccgatggaggcaaagttgataaaggaataggcctggttggcctccagtaatttcgccgagtaatgcccgaccaattccagcttcagcatggcgcggctccttcaaatgactgaaggggttggccgccccacggagatgtaggtgaagccgcgtttgctcaaacgctgcggatcgaacagattgcgcccgtcgaaaatcaacggttgtttgagctgctggctgagcagatcaaagtccggcgcgcggaacgcttgccactcggtgacgatgatcaacgcgtcggcatttttcagcgccgcttccttggtgccggccagcgtcaggtcatcgcgcgcgccatacaggcgctgggcctcttccatggctttgggatcaaatgcctgaacgctggcgccggcgtgccacagagcctccatcaatacgcggctgggcgcttcgcgcatgtcgtcggtgttcggtttgaaactgagcccccacagggcaaacgtcttgccgcgcaggtggccgtcgaagtgattgaaaatcttgctgtaaagactggctttctggtcctggttgcgcgcctctacagccttgagcagccgggcgtcgatatcgacacttgttgcggcgtggatcagcgctttgacgtctttgggaaagcacgagccgccgtagcccacgccggggtagataaactggtaaccgatgcgcgggtcggcgccgatgccgtggcggactttttcgatgtcggcgccgagcttttcggcgaggcaggccatctcgttcatgaagctgatcttggtcgccagcatgcaattggcggcgtacttgctcagctcagcgctgcgcacgtccatgacgatgattttttcgcgactgcgattgaacggctcatacagttcgcgcatcaccgcttcggcatgcgcgctgtcggtgccgatgatgatccggtccgggcgcatgcagtcttcgatcgcgcagccttccttgagaaattccgggtttgacaccacatcgaacgtcagatggctgcgatcgttgtcggccagcacctgctcgatacacgcacgcacctgatcgccagtgccgaccggtactgtggatttgtcgacgatgatctgatgccgatccatgttcagcgcgatggtctgcgccacgctcaagacgtattgcagatcggccgaaccgtcttcgtctggcggtgtgccgacggcgatcaacagcacatcgccatggtgaacggcgtcggccagatcggtgccgaagcgcagacgaccactctgataattgtcgcgcacaaggcttttcaggcccggctcgtagatcggcagcgtgccttgtttcagcgcctcgacccgggccgcgtcgacatcgacgcagagcacgttatgcccgacctcggccagtgcggcgccctggaccaggcccacgtaaccaataccgaatacgctcacattcatggtcaaacctcagatcgtggtgaaggttgtcaacgcaggggcagggcggggatcaagcggtcgggcaggggtcagtagatgtttttcgagaacagcgtgaagggcgtcttgatgaggattttgatgtcgagccacagcgaccactggttgatgtagttgaggtcctgggcgacgcgcagctgcatcttttccaccgtctcggtttcgccacgatggccggtgatctgggccaggccggtgatgcccggcttgaggcgatggcgggccatgtaggcgcgcaccttgccggtgtaataaatgttgtgagtgacggcatgcgggcgcgggccgaccagggccatctgtccggagacgacattgaacagctgcggcaattcgtcgatggaactgcggcgcaggaagccgccgatcggggtgaggcgggcatcgtcacgggtggcctgacgcacctcacgatcgtcgtggacatgcatcgaacgaaacttccagaccttgatcacttcaccgttgcaaccgtggcgggcctgcttgaacagcaccgggcctgcggaggtcagcttgacggcgacagccaccaccagcagcaagggactgagcaggataatggccgcgccggccaggctgcgttcaaacaggtccttgcaaaacagactcgccgggtgcgagctgatcaggctttcattgaggtaaatcgccggcatccgctcgatttccgagatcgaatggttgagcaacaccatgctgccgaaatccggaatccacaccacgtcgacattcatgtccaagaggtcgatgtacagcgcttcgatggtcgccgcatgcgccatggtcagcacgatgtagacgcggcgcacctccaggcgcgtgatgatctcgcggatcgcggcaacgtggccgagcagcggcagaatgcttggcgccgggccgctgttgtcggcagcggcgatgaaaccgagcaccagcgcgcggttcggtcgcgagagttttttcgccagctcatgagccgtcgggcaggtgccgatgatcaccgaacggcgctctttgcagaccctgcgcgagtgcaatcgggccaggtaatgcaggggcagaaagcttgctgcctggaccacgaaacccagcaccgcccagaccatgatcacctgccgcgagtaaatcgcgctggtctgggtaatgaaggcaatcgccgccagcacagccagcagaatcagccacgctgcgagcaatcggcccaggccgaccaacagaccatggcgcttgtggtagacctgcatcacgctgtaaatcggcaccgaaccgagcacggcgagaatgatcaggatgcggtattcgctgttcagactgccgacgcgccaatgcacgagcaacatcagcaatacggtggtcaacgacagcgcacacagccactggccccagaaggtcaggccccggcggtgcgtcatgtgagcggtatagagcggcgtcatgggcttaacctcaaggcagcagtcatgcatcagcgctaatcgaacggacaggacgtgtcgcccgatggctattccgtagctcggcagaggtgaagcgggttgtgcgatggcagaagggggcgtagcggctggcgtattcgcctaaggtgttacctgggcgcgaaatcgtagttatagaacgcccgggagtgttgatagccgtacttgcgcgccttgcgcaggtcgacctggttgagcacggtgccaaacaccggcacatggctctgttgcaacatggccaggccgcgctgcacctggctgatcggcgtgctgtcggccttgaccacgtagatcacggcatccgaatgccgcgccagcaacaatgcgtcgctgatcatctcggctgggggggaatcgataatgatgtggcggtaacgcgacctcagtgcctcaagcatgcgcgccatgcgcggtgagctgagcagatcctgcggcggtggctgtaacggattgagcgaatcggccggcgacggcaggcgcggggcggcaaacatgtccagcggtggcggcagaaccttgcccgccggcaacatgtccagattgcccaccgagacaatgcagtcttcaagcctggcggtgccggcaatgacattcgccagccccgggctgtctggtgggaagtcgaagttcagcgacagggttggctgacgcatgtcggcatcgatcaacagcacacgctcgagtgatgtcagcgagctggccagattgttggcaatggtgctttttccctcaccggcaaccgtcgacgtcaccagcaccacctgcgagggcatttcgctgctttgcagcatcaaccaggtacgcaggttgcgaatggtctcggaaaaacgcgggttgtcgttatcctcgaacaagcgcgccagttgccgacgggttttcttcgtcaccagtggcacgacgctgagcagtggaatgttcagcgcgctttcgatcgattcgtcggttttgaaggtattgctcaggctctcgaagagcagcgccaaggcaacgccgatcaccgcagcgatcaacccgacgatcgcgacaatcaaggttttccgcggtttgctcgcgtcgaccgggacaatggccgggtcgacgatgcgcaccttggtcgagtccatgtcggcggtggcggtggtttctttcaagcgggtgacgaaggtttcatacagcgcgcgggagctgtcgacctcacgctggaactcgcgcaactggaactctttacgcgcaatgtcctggatctgcgccttgttgctgttgaacgactgacgcaacgaggcttcgctggcggtggcgagctggtattgccgttcaataccggcgaccacttgctgcacctgcaattgcaggctggtggtagcggtgcgcaattcggactgcgcagaaagcaggctcgggtgttttggcccatagcgacccgccagttcatccaccttggcttgcgccacggcccggtcggcctgaaatttctgcaccaaaggattgctcagcaccgcaggcacgctggagagccggctcagatcgccgttgcccaaggccttcgcctgacggtactcactctcggcttcggcgcggttgcgccgagcgtcgaccatgcgattgccggtcatttccagttcgttggcgctgatggtggcaacgccgccaacgtcgaccagaccttgttcttcgcggtagccctgaagttttttctcggcgacgcgcaagttgtcgcgcaatttgaccagccgtgtgttcatccaggccgtagtggtttgcgaggacttttcgctggtgtcgagctggctgtcggtgaagccttgggccaacgcattggccgccgcagcggccagaaccgggtcgggcaactcgacctcgatttcgagcaactggctcttgccgacgaacttgacgctggtgtgcagcatgaggttctgcgtgacctgattgaagacgtcctcttcagtgggctcgtctattttgctcaacggcatcaaccggctcagccccgggatccattgatcaaggtcgagatcagccaaccactggcgcggtgtaaaccagggctttgcttgctgacgcgggtcggtaaccgggtgggtggtcaggccgagttttttcactgcgcgttcggcaagatcgcgcgattgcaggagcgcctgctgggtctgcaagtaatccgtggcgttgccgccggaatccttgacttgctggaacgacatcagcggcggggttttatcgttgaacagcaaggtggtgctgccgatgtactgcggcgtgatgttcgagaccacaattgcggccagcgcagcactcgcgagcaccagccaggcgatgctccatttggcgcgccagatcactctccagagctttaacaggtcaagggtgtccttgtcttcgctgtactgctgatgcagatgcgcttgcagaggacgttcgacgtaggtgctagggctgttgtccatgattagaaaaagccttgtgcaatggaaatggtgtcgccgggggcaatcgtggtgttgcgcgtcacgtcatcggtgagggtcgcgccaccatcgccgcgcaaaatggtcacgcgcttgatcgaggcgcgctcggtcaagccaccgcccagggcaatggctttctccagggtcaggccgggtacgaacgggtaactgccgggtttcttgacttcgccattgatgtagaaagagcggtattcgatctggctgaggctgactttcgggtcgatcaggtaaccctgtttcagcccgtcgacgatgattttttcgacttggccgggggtcagtcccttggcggaaatctcgcccagaaaaggataggaaaaggtcccggcgtcactgaggcggatctttttcaggctcaattccggctcaccgaagacgatgatgcgcaagacatcgccagcggccagtttgtattgggtgctgggggctgcggcaaaggtatgaggtacaaaactcagggcgaacagcaagacgagtgtgcgtgtgttcatgtcgagaccctcttaaaggctgacgttgaaactgatctggaacacgttgcgggtgaagctttcatcgtcggcatcggaatcgttgtcgcggtaccgatagcccaattcgatatccagccagcggcgcatcgcgtacaccacggccaggttgtagtcctgcagatcgtcggtacggctttggccttcgtagacataacggccaaacccggcttgggccaccgtggtgatccgttcggtccagccgtgacgccaaccgacctgagtgaacgtcgacttcacggcatcagcgccatcgtcaccttcggcaagggcctgacgagcgacaaaggtaaacgtcgaataggttcgcggtttccattgcaagtccacttgccaggtcgggttgtcgaggtctttggattcgctgttgtcgaagttcttgcgctcatagccgaggcgcactttgccggttgtacgtgcggtgaagtcccacacggcaccggccagtaccgcatcggatttactgctgcgcgggctgttggcttgctgataatcgaagtcggtgtggtcatattccagcaggccgcgagtgttactgccgatgcggtggtaccaggtgctggtgagggcggtggtattgcgttccttgtcatcgttgatgccgtcggcattgtcgtagcgaagttgcgcgtaactggccccgacatcgatttggttgtcggcacttttagcgccgaaggtgtagagaccccccacgcgtttattgttgagtttgtcgttgatgccctcgaccgccgtcgactcggtgcgctcccatttacggtattcggcgtcgagcttgagacgatggcggtcggtgaactccatgatgctatcggcacgcacgcgctgggcggtgttcgaggcatcggaatcgtcgtgatagatataacgcgtgggttgccagatcagtcgagtggcgctgttgcggtcttcggccttgagctcgaaggtcggcgccagtttggtgatcatcgatgactgtttactgttttccacttcgcgaaagttatcgtcataactttctgaaaacaaaaaggatggcgtgaaatcgaatccgtaaacattaatggcctgcggatcgatactccacgccattccaggatagagcgaggccatcagcagtgcgacagggcatcgtgacttcaaagccatgttatagctcctgagcaaaggcatataaggcaaggggttagtgatagttctgaacgttggcttgttggcgttcgatcacgctgagtggcaagcaaaccgattgttcgcgattcagaaattgcaggaggatcatcacgcggtcattgccgtgcaaaccgagaaacacgccctccaagggtgccagcgggccgctgacgatctgcaggttctgccccggtttcagcgcctcgtccggccccgacagcgatgattcgatacagcgcacacgcaggtgctcgatgacgtgctctgccaccgtcgccggcccgtgattgaattcgacgatacgactgaccccgcgtgtagaacgcaagggcccccaattgtcgttacgactgagttggataaataaatacccgggaaatagcgattcgcgcactcgctgtcgtttcccacggatgattcgttcactgaggagttgcggatggaataccacgtaattctgttgaagcagattgaggtgagcgcgctcatcctgacgtggcttgcattgcaaaaggtaccaaaagggacgttcggagctgataactggcatgctggtaaactctgtaatgatcgaaagtttatgcaggcagaagctctatcgagggctaagtaagggcaaatggcgaaagtctgttgttattttattaacactgaggtgtttcaatcttgaatcacacagcgtttcattaaggtgcgtccagctgaggcgtgacgctatagtgtgcggcgcatggggaataagccgcggcttaacttttctgaagacaaagctaccgcacggtctgctgatgcagccttaacgataggtaactaagtagttgtctctgaaacgacagggcgcgagtagaagttgctcgcgccctgtaaaaatgaaccttggtagttatcggccagtctttgcggtctgtcaaacgttcgcagtcaaaaaacacgccatttatctgctaatgatggcactcgcgcgcaggttattgttttctaaggcgtcatccttttgtcggaaggcaagaaactttactgtcacttcagagtcgtcgctcgctatttagatcggaggttaatccccatagttggggaagttataaagtctggactccgcaagtcgaccaacgctataactaatcgcctggcgacttggctggagaggcgaatatgtccgttcttgttacaggtgctgcaggctttatcggatatcacacggtcagacgattgatattgcaaggccatcaagtaatcggcatcgacaacctcaacgattattacagcgtggaactcaaacaggcacgcctcaagcaattgagcgacctgcacggcttccatttccagatcatggacattgtcgataagccagccttgatggctctgttcgaagagcaggggttcaccgaggttgtgcatttggccgcgcaagcgggtgtccgctattcgctcgacaatccggatgcctatgcgcaatcgaatctgttgggcttcctcaatgtgctggaagcctgccggcactatccacccgcgcacctgatctacgcgtcgagcagttcggtgtacggcgccaacagcaagttgccatacagcgtcgatgacgcggtcgagcatccggtttcgctgtatgccgccaccaaacgcgccaatgaattgctggccgacagctactgccatctctacggtctgaaggctagcgggctgcgattttttaccgtctatgggccatgggggcgaccggacatggcgttgttcaagttcaccgaagcgatcctccaaggacagccgattgacgtgtacaaccagggtcagatggcgcgggactttacctacgtcgatgacgttgtcgaaagcatcgtccgcctgtgcccgaagccgccggtgccgaacgaggaaggcgagggcagccaccggattttcaacctcggacgtggcaggccgatagcgctgctggattttgttgactgcctggagacagcgttgggcaaaaaagctctgcgcaacttgctgccgatgcaggccggcgatgtggtcaagacctgggctgatgtttcggcgctggcagactggatcgggttttcgccgcaggtggaggttgaaaccggtgtggagcagtttgtacgctggtatcgcgagtattatcgggtgtgagtaatccggtggggagtggccagagcaactgccatctcgggcgcctgaaaaggcgccctttttatgcattcgcgcttttcatcaataggcagcgtcttcatttgatcgaaacaacaaccttgcccttggcgcgtccctgttcgacgtatttcagcgcctctgccgctgattcaaaggggaacgctcgatcaatcaccggattgatgatgccggcttctaccaactcgctgatgtgttgcagttgggcgccgttggcgcgcatgaacacgaacgtgtacctgacgtcttgcttgcgtgccttgcgccgaatgccgaggctcagcagacgcatgacctgctgcaaaggccaggacaagccttgctcttttgcgaattgcgcggtgggtggcccagagatggaaatcagctggccaccgggcttgagtaccttgagtgatttctccaggacatcggcgccgaggctgttcaacaccacgtcgtagccgtgcaggacattttcgaagttgtgctttttgtagtcgatgaccacgtcagcccccaacgccttgacccattcgacatttgcggcgctggtggttgcggcgacaaaggcaccgaggtgtttggcaagctgaatggcaacgctgccgacgccgccggagcccgcgtgaatcagcaccttctggccctgttgcaggcgggcggtgtcgaccagcacttgccaggcagtcagtgccaccaagggcagggatgcggcttgcgccatgctggtgttgcgtggtttcagggcgatcgcgttttcgttcacggcgatccactcggcgaaggtgccgattcgcgcttgcggcgggcgagcgtacacctcgtctccgggtttgaagcgtgtcacttgcgagccgacctcagtcaccacgcctgccagatcgttgcccagaatcagtggaaacgagtagggcaggatcagcttgaattcgcctgtgctgatcttcgagtccagcacgttgacactgctggcatggacctcgatcaatacgtcgtgaggacccactgcaggggctggcgcttcgccgaggcgtccggggtgcctgccatagcgatcaatcagaaaggctttcatcgaggtgcggctcttgtcggttgaagggagggtagccggggcgtggtcaggcatcgaggaacgcctgcgccttggccacaaaatcaacgtggtgctggaaaatcccgccgtgaccggcatcctgataaatcaccaactctgcgttggggatacgcctggccagttcaaacgaattgacgctgggcaccatgatgtcggtgtcgccgttgacgaccagcgtcggcgcccgcaagcgtccaaggtcttgcggcggctgtttgccccatgcggtgatcgctttcaactggcgcaggaaagcgcggggcgtcgggccttggtcgcgataggcaaagcgaacgccgttggcggtgacggactggtttgccgcgtcgatgaatgacgttggcgaacccgaagggggatttgtctgtattgaattcatgactactccggattgcaggacggattcgatgcaatgccttgtgcttgcatcgaatccgccgcacatgctcgcgccctgaagatcactcaggcgtctggtagcgctgggcaaccgctgactggcggatttgccccagcaggccctgacgcgcggtctgcaaatcgtcccagcgttgcgcttcgtgcagcggcgggatggtgaccgtttcgcgacgatcgaaaccgaccagggcagcatccaccagatcgcccacttccatgatttcgctcagggtgttgatgtcgacgccggagcgatcccagatttccgtgcgcgtggccgccggcagcacggcttgcacgtagacgccctgaggcgacagctccaggctcaaaccttgggacaggaacagcacgaatgccttggtcgcaccgtagaccgtcatgccgaattccggagcgaggcccaccaccgagccgatgttgatgatcgcaccgtcaccggccttggccaggcgtggagcgatggcgctggcgagccgcaccagcgcggtggtgttgagggcgaccagttgcgccactttgtcggtgctttgctcgacaaaatggccggacagcgcggcgccagcgttattgacgaggatgccgatgcgggcgtcgtcgcgcaggcgggtttccagcgttgtcaggtcgccaggttgggtcagatccgccgggatcacatcgacggcgacgtcatgctcgctgcgcaagcgcgcggccagtgcatccagacgcgcctgatcgcgggcgaccagcaccagatcgtgaccgcgttgcgcaaagcgctcggcgtagacggcgccaatgccggtggaggcgccagtgatcagaacagtagggcgaatgctcatgggtatctctctttcaggacgttagaaacagaacgcgttcagcttgcgctgacgctcgattcagccagtgtcgggtaatcgatgtagcctgccgcgccgccgccatagagggtggcgggattgaacgcggacaacggcgcgccatgtttcaggcgctccaccagatccggattgccaatgaacggacgaccgaaggcaatcaggtctgcctggtcttcagtgagcttcgacgtcgccagatcgaggtcatagccgttgttggcgatgtaggtgtttttgaagcgctggcgcagggcggcgaaatcgaagggcgccacgtcacgcgggccgccggtcgcgccttcgaccacatgcaggtaaaccacgccgaaggcgtcgagttgttcaacgaggtaatcgaattgcgcctgcggatcgctgctggaaacgccattggccggcgacaccggtgacaggcgcacgccggtgcgatctgcaccgatctcactgactaccgccgccgtcacttcgagcaatagccgcgcgcgattttcaatcgagccgccgtaagcatcagtgcgcagattggcgttgtccttgaggaattgatcgagcaggtagccgttggcaccgtgaatttccacgccatcaaagcccgcggcgatcgcgttggctgccgcctgacggaagtcgttgacgatgcccggcagttcgctgctgtccagtgcgcgcggctcggagacgtcttcgaaacggttgtttacgaacactttggtagcggcgcgcagcgcagaaggggccaccggggcggcgccgttttcttgcaggtcaacgtgcgagacgcggccgacatgccacagttgcagaaagatttttccgccctgggcatgcaccgcatcggtcacggtgcgccagccgtcgatctgtgcccgcgtgtagatccccggggtgtcctgataaccctggccctgccgggagatttgcgtggcttcgctgatcagcaaaccggcgctggcacgctggctgtaataggtcgccgcgaattcgctggggacgaaacctttaccggcgcgattgcgtgtcagcggcgcaagaacgacgcggttcgacagcgtgagattgcccagcgtgtatggggagaacagggtttgctcggtcatctgatgtttcttccgtgcccgttaatgaagatcgatggtgcgagcaattaggatgatgatcgaaatctaaactgtcaacggttttgattatggccaacatctatgtatcatcggacccaggatttccccggtaacacgaggtattgcacgtgagagtgaccaaggcccaggcgcaggccaatcgagagcacatcgttgaaaccgcctcagagctgttccgtgagcgcggctttgacggcgtcggtgtggccgatctcatggcggccgccggttttacccatggcggtttctacaaacacttcgcgtccaaggccgacctgatggccgaagcctcggcgtgcagtctgggcaaatcgctgaccggcgcccaagcgctggatgttccgggcttcatcaacgtctacgtgaacagagagcatcgcgacggacgtggcgacggttgcaccatggccgcgctgggcggcgacgcggcgcgccagtcggatgaggtaagagcgacgtttgccgagggcattgagcaaaccctgcagactctgggagacaaatacccgacggtgccggaggccgaggcgggtgaggggcgcaagaagatgatcgacctgctgtcgcgtgccgtcggcgcgattatcctgtcgcgtgcctgcccggatgattccacgctggcagacgagattcttgaagtgtgccgcgcgcaaatgctcgcttcgttgccggccgataacgccgacgcagagtagcagcgcggctcactctgtcagcgctttggccttggcaatggaaaacgcttgcggcaggcgggcgccattcttcgccgcaagaatctcggccatcacgctaacggcgatttccgcaggtgtcttgctgccaatgtagaggccgatcggcccgtgcaggcgttcaagcgacgcctcggtttcaccgaaatgctcaatcagacgttcgcggcgcagctggctgttgcgccgcgatccgatcgcaccgatgtagaacgccgggccgtgcagcgcttcgagcagggccagatcgtcgagtttggggtcatgactcaaggcgacgatgcaggtgcgcagatcgaccgcgaagtcgcggaccacgtcgtccggcatgccgacgatgcgctccacgccatcgaccgcccaggtttcgatgtactcgggacgcgggtcgcacaccgccactttgaaaccgttgaacaaggccatggtcgccagatactcggccagcgcgccggcaccgatcatcaacatccgatagcccggccccagagtgttgagcatctgcgcgccatcgaagctgaattgttccggcgtcgcggtcggttcgagcatcacctgaccggactccaacgccacacgccgacgcaccaattgcccggcatccagttgcaccagcaacgcgtcaagcgactgccacgacgggttgaactcaaggatcagttccagcgtgccaccgcacggcaagccgaagcgatgcgcttcgtcggcactgacgccatagcgcaccacttgcggtgcgctgtcgctaaaagcgctgccgccatgagccgtagtgaagcgatggatcagatcgtcctcgatgcagccgccggatacgctgcccaccacgcgaccatcgtcacgcaacgccatcatcgaacccgtcggccgtggtgaagagccccaggtgcgcgccaccgtagcgagcaacacacgctcgccagcggcaagccagtcccgcgctgtgcgcaggaccagcaagtcgatgctttccatcaaaacctcctcttagcgcatctgcaggatgatcggactgctgctggccggatcagtatgttcacgcagtttgcccaccgcctgcacatcgaccgcaccgccctgattaccccaagtgctgcgcatgaacgtcagcacttcagcgatctgctgatccgacagctgctcacggaaggccggcatgcgataagcgtccggtacgccagccgcgacgacacgctgcgaaccattcagggtgatgttgatcgccgaagcgctttccttggccagtgcagaagtcgcgccggccagtggcggcatccattcaggttgtcccttgccgtcgagaccgtggcaggaagcacagcgcgtcacgtaggtatgggcaccgggcgagtccagacgttgcgctgccgacaccgcttgatactgccaaggtgcgccatcccgttcgcgatccccgggaagcgacttcaggtagtgggcaatcgcgctcaaatcatcatcgctcatgaactgcgtggagttgttgaacgcctcagtcatcgagccgtagaccaccgcgtgtttattgcgaccggtcttgaggaactgcacgatctccggttcgctccagcggcccaggccagtgttgtgatcatcacgcaggctcggcgcgtaccagccatccagcagggcgcccgcgaggtacggtttaccggattcatccagtgccttctcgttgaacgccagaccgcgcggcgtatggcaactgccgcagtgcccggcgccctgaacgaggtaagcgccacggttccattgttcatcctgcgacggtttcgccgcatacggctcggcgtcgataaacacgccattccacagtgcaatcggccagcgcaggttcagcggaaacggaatcgcgctggggatgttcgcctggttcaccggcgccacgcccttcatgaagaacgcatacagcgcgcgcacgtcatcgtcactgagcttggcgtaggacgggtagggcatcgccggatacagacggcgactgtcgggcgccacgccgtggcgcaccgctcggtcgaagtccgccaggctgtagtggccgatgccggtctccgtgtccggggtgatattggtcgcatggattgagcccagcggcgtggccatttccaggccgccggcgaatggcgcgccacccggcacgctgtggcaggccacgcaatcgctgagcctggcgacgtattcgccacgggcgaccagtgccgggtcgatatcggccacggcgatctgatgggtttcaaggcgcgagacaggctcgcgggtgacataccaggccagcaggcctgccgcgaccaggcatggcaccgccagccagccagcggttcttgcgaatcggctgttgttcatggacgctccggcgctgatcaagtgaaggtgtgtcggctcatgggcaggctgcgcacccgctgaccggttagtgctgccaccgcgttagcgacggcgggcgcgaccgcgggcaacggtggttcaccgatgccacccattttttctccactctcgaccacacgcacatggacccgagccatccgcgcaggcggcaggatcggatacaagtcgtagttgcgcgcccggggtttgccatcaatccacacggcttcttccaccagggtttgcgacagtcccagcgccacagcgccattgacctgcgcttcgacaattgccgggttgacgatgctgcccgggtcaatcgcttgccagatgtcatgcaccttgacctggccgttctcgatggacacctcggcgatcaccgccgtctcggtaccgaacggcgaagccatggccacaccgcgcgcacgtttgctgccatcctcggcggtaaacggcccgcgcttccagccgcccgacagttcacccaccgcttgcagcaaagtggtcaggcgtttgttgtcgcgcagcagatgcaggcgcaagtcgaacgggtctttgccacccttgtcggccagttcatcgaggaacgattcataaaagaagtcgttgagcgaattgcccaccgaacgccagtaaccgagcatggccgggcctttggcgtaaatctgcgcgatgcgcttgttggggatcgcgtaggacttgccggacaagccttcaagcgccgttgggtcaagtttttctccttgcttgccagcgagggcttcggtcgggccttcggtggcactgatcgcttcgattgccagcggccagccgtcactgtccagcgcggcacggaaattcaccgcggccacgggacggagcacgtcacgcaggaactcttcctcgcgactccagatcagcttgaccggacggccaacggccttggacagcgcaatcgcctgcggatagggactggccgagtcgtagagaaaatgccggccgaagaacccgcccagcagcggcgaatgcaaggtgatgcgcgacgggtccagccctgtgcgtttggcgatgtcggcgcggaacatgtccggcgcctgattcggcaaccagacttccagcgaaccgtccgggttgaatcgggccagtgccgaaggaggttccagttgaccgtggttcaggtattgattgtggtaagtggcgtcgatccgggttttggtttccttgagaatcgccgccacgtcgccttcatgttcatcatctttggccgggcctttatcttcagcaaggcgcttgaaccagccatcgctggagaagtcggcgggcatcggccgcactttgctctcagccgttggttcttgccagtcgacctgaatcgcctcgaccgcacgtttggcgtgccaccagcgctcggcgactaccgccacggcacccggcagacggtgcacggaatgcacgcctttcattgccttgacctgctcttcgttgcgcaggttgcccacggtcatgcccaggcgcggggcatgttgcacggcagcatggagcatgtcgtcgactttgagatcgatgctgtacagcgccttgcccgtggatttgtcgtaggcatcgaggcgcttcaccggtttgccgatccagcggaactggctcggatcacgcagcttcacggaagccggatcgggaaccggcagatccatcgcgcgctcggccagttcaccgtaagccagcgagcgccccgacttggcatgtacaaccttgccaggttcggtgctcaactcgctcaccggcacgccaagttgctgcgcgcccgcctgcaataacatggcgcgggcgagggcgccaaggcggcgcatcaccgggtaactcatgcgcaccgacatgctgccgccggtgatgcgcatgccgttttccaacaccacataggcctcgccgggcggtgcggcttcgaccagaaaggtcgatggatcggcatccagctcctcaccgacgatttgcgccatcgcggtgaacgtgccttgtccgccttccatgaacgggcagagcagacgcacgcggttgtccgggcggatctcgagaaacgccggcacctgcgtgccgcgctcggccgtcgccgctgcaacggcagcttgcacccgcgtcgcacccagcggcaggccgaagccgaggaccagtgcgccgacggcggtaccggtgagaaaacgtctgcgcgatacattgatcggctcgtgcagatccagcaccgaggcttgctgtgaagggtcgattcgaacgttcatcacgcgtctcccttgccggccagctcatgcacggcagcatgaatggcgttgtaggtaccgcagcggcacaggttgaccatcgccgcttcgatctgcgcatcactcggtttcgggttttgcttgagcagcgcggtggcggccatcacctgcccggactggcagtaaccgcactgggcgacctgcagatcgacccaggtcgcgaccacccgtttgcccacgtcatcgctttcgatggcctcaatggtggtgacctcgcggccaaccacaccggccaccggcgtgacgcacgagcgcaccacattgccgtccaccagcaccgagcaggcgccgcattgcgccagcccgcagccgtacttggtgccggtcatgcccagatcatcgcggatcacccacagcaagggcgtatcggcgtcggcatcgacctgataggtcttctggttgattcgtagttccatggttcacccgctgatcatcggttgacgtgcattgttatgagcggtgacacgcggcgaggcggatcaccggtgaagctggttgttcgtttaattcgctaggctgccgagcgcttctgcctcgaatggctgcccgcgcagcagggcgatgtcacgacttggcgcggtgccgaacagccggccatattcgcggctgaactgcgaagggctttcatagcccaccgcaaacgccgcccgcgacacgtcgaggcgctcgaccagcatcagccgccgcgcttcgttgagccgcagccatttctggtactgcagcggactcatgccggtgagttggcggaaatgatggtgaaaggtcggcgcgctcatctgcacccgcgcggccagatcgtcgatgcgcagggcatctgcgtagttgagcttgagccagtcaatcgccttggcgatgcgataaccctgaccatcgacggccgtgatctgccgcagccgcgcgccttggtcggtgtgcagcagccgatagtggatttcgcgcaaaatcagcggcgccagcaccgggatcgcctcgggttcatcgagcaatgccagcaggcgatcgagcgcgcccgccaacgccgacgacagactgccaatcgcggcgcccgtgcccgttgcaggctgccgcttggccggtaagccgcttttggtgatgacctcggcgagcatgctgacatctagtttcagtacgaggccgacacagggctgtgcgggactggcgagcgtcacttcggcgttggcgggcagatccagtgaggtcaccaaaaaccgcgaagggtcatagctgtaaccctcgccaccgacccataagcgcttttcgccgcgaccgacgagaatcaggctgggttcgatcatgcacaccaccggcggcgcgggctggtcgcgacgaaacagcgaaagcccgggtatggccgtggcgaaatcgcccggtgcgcttacgcgcgggtctatgtgcaatgccaaaggtgattcctcgggcagaggggtagggatcatgtcgggtcactcctgttgaccgaactctaatccgcgcgcgagacgtttcctatccatcaccctgcatcgccagaggatcaggcaagcattcaagaggaatgcactagggaaggggcggattgaccgggagaatgtgtctatctgttacaggggcagtgctcgcaagagcgacaaaatgcttgcccctgcgcatcacacccttacgttttttcgcaccacaggtcgttccaatgacatttccttctacagatccttctaaaagaacaggcggctggagcgcggtgctggccatgtcgctggccgcattcgctctggtcgcttcagaattcatgccggtcagtctgctgacgccgattgcggcagaactgcacatcactgaaggccaggccgggcaggggatttccgtgtcgggcgcctttgccttgatcaccagcctgttgatcgcctcggtcgccgcgcgcatcgaacgcaagaaattgctgctgggcctgaccttgctgatgatcgtctccggtacggtcgtcgcggtcgcgccgggttatccgtcattcatgtttgggcgtgccctgatcgggatagcgattggtggtttctggtcattatcggcggcgactgcaatgcgtctggtgaagcctgaacaggtttcgcgagcgctggccatcgtcaatggcggtaacgccttggccacggtcatcgcggctccggcggggagctttcttggctcgctgatcggctggcgcggcgcgttcttctgtgtggttccggtcgcggtgctggccgccgtgtggctgctgatcagcctgccgtccttcaaggtcgagcgccaggcaggcagcggcaacgttctgcggctgatgaaacaattgccagtggccttgggcatggtcgccgtcagcgtatttttcatgggccagttcatgctgtttacctacctgcggccctttcttgaaggcgtgacgggcgtcagtgtttcaaccttgtcgttgatgctgctggggttgggactggccggttttatcggcacctttctgatcgaacggtttatgggtcgcggcctctaccgcacgttgaccgtcatcccgctgatcatggcggccatcgcgctggcgttggtcagcttcggcaaatcaccgctgctgaccgccgtgttgctcggactctggggactggttgccacggccgcgccggtcggctggtggacatggctggcgcagacgctgccggatgatgcggaagccggaggcggactgctggtagccattgtgcaactggcaatcgcgggaggcgcaatcattggcggtctggcttttgacctgagcggttacaaagctacattcgagcttagcgctgcggtgttggtcgtcgcgtctgtgctggcctggttggcggggcgcaatgccactgaaattcatcttgttgagtcggcagctcattcgaacgctgtttccggcgatcctgagacccgatttgtctgatcaagcagaaggctgcttagtgcaccaatgacggttgggtcgcgaccgagacagtgaagaccacgacaaacagcacgacgattccccagaacaacaccatgactgtcagcatgacgaccctaaggccttgataaagcctgcgcagccaatggccttcgggttttgcgtctgcgcgggttctgagtacgcctttcaagtaaaaaccgaggagcgccaacagcgcgccatcaatcgccagcgcaggcaggccggctatggggaaaatgctttcccaccgatagaaagaagaccggctcagaaagaccacataacaagtcagactgccgtagggcagtgctctccaccatttgccggccagcggcccgaccatcaggcacatgatcaccatgaacgggctgaggagaatatggatcatccattccagtacgttgggcaagtagtccggggaatggatgttgcgccagaggtgttccaacattgatcgggttccttccttccagggagtcagtgttgctgcggtgcttccatgctgctgcacggtatcggcgtgtttttgggttacataagggttgtcggcgtttcgtcatcctctagcggccgctagcgccacggtcatcaccccctcgctctaccacgctctgtttttatctctgttcatcccccgataagaaaaaccgatacctgcttaaggatttcccagaggcgggcggtatacctgcggctttacagtcacctccatcgttcagcgtggacggtccacttacaggccttgtccgtcgggacttctacaaaaataagaaggtgacagcatgagtagtgaaacggtcgatatcaaagcatggatcgacaaccgcaaagtggtcccgtaccagtggctgattatgggtttatgtttttttatcgtgcttttcgatggcttcgacgtcgcggtgatggggtttattgccccctcgctgattcaagaatggggattgtcgaaagcggcgttcggcccggtgatgagcgcgggcatgattgggctggcgatcggcgcgctgaccgctggcccttacgccgaccgaatcggccgcaaaaaggtgctcctgacggcggtgactggcttcagcgtgctcagccttgcatgcgcctttgcacgtaatccctacgagctggctgccttgcgtctgctgaccggtgtggcgctgggcgcagcgttgccaaacaccaccacactgctttccgagtatttgccggaacgcaatcggtcactgttcatcacgatcatgttcaccggattcaatatgggttcggggttgggcggatttctcgccgcgtggttgattccccatcacggctggcagtcggtgttgctcgccggcgggattctgccgatgttgctgctgccgttgatgtggctgttgctgcctgagtcggcgcgttttctcgccgcacgcaacgcgcccgccagccagattgccaaggtgctgaacaagctgggcggcacgttcagcgcagcgacgaaattcgtcatcgccgaaccgcaggctcagcaaaaagcaccgctgcgcttgctcttcaccgatcactatcgtttcggcactctcgccttgtgggcaacttacttcatggggttgctggtgatctacctgaccatgggctggatgccgaccctgctgcgtgaaggtgggctgtccatagaacgggccgcgaccatcaccggactgttccagattggcggtactgtcggcgccatcgtggttgggtgggcgatggaccggcgaaatccgaacgcggtgattgccacgtcttacgctctgggtggcgctttcattctgctgctgggcgccttcagccttgaatcgggcctgctggcattcggcgtggtggcggcaggtttctgtatgagcggcgcgcaaaccggcctcaatgctttcgcgcccggttactactcgacggactgccgcgccacgggcgtcagctggatgctgggtatcggccgcttcggggctatctttggttcactcatcggtggcgcggtgctcagcctcgggctggggttgccgctgctgtttgccctgttgagcgtgcctgcctttatcgctgcactggcgatcctggccaacggtcatgcacggcgccgagtcagtcgggccttgctggcgcattaatctttttcaacaaaggaactcgttatggcacgcatcattggtggcctcgctgtatctcacaccccgaccatcggctttgcggtcgatcacgacaagcagcatgaggccgcctgggcgccgatcttccgtggctttgagccgatcaaggtgtggctgaaggagcagcaaccggatgtgctgttctatatcttcaatgaccacgtgacgtcgtttttctttgatcactatggtgccttttccctcggtgtcgatgagcgttacgaagtcgccgatgagggcggtaatccacgcgagttaccggggatcgctggccatgcggcgctgtcacggcacatcggcgagagcctggtggcagatgaattcgacatgagtttcttccgtgacaagccgctcgatcatggcttcttctcgccgatgtcggcgttgttgccgtgcgagccggactggccggtggaaatcgtgccgctgcaggttggcgtgttgcagttcccggtgccgagtgcgcggcgttgctacaagttgggccaggcgctgcgccgggcgatcgaaagctaccccgaggacttgaaagtggccatcgtcgcgaccggtggcgtttcccaccaggtgcacggcgagcgctgtggtttcaacaacccggagtgggaccagcagttcattgacctgttggtcaatgatcccgagcgcctgaccgaaatgacccacgccgagtacgccgcgctgggggggatggaaggttcggaagtgatcacctggctgatcatgcgcggcgcgctgtcggcaacggtgaaaaacctgcaccaggattactacctgccttcgatgaccggcattgccacactgctgctggaaaaccaggatcgacccgttcccgccgacgtcgttgcgcggcacttgcagcacatgcagcatcagttggcgggtatcgagaagcttgaagacacctatccgttcaccctggaacgcagcgccaagggctatcggttgaacaagtttttgcaccgcatgatcgagccgcattggcgtcagcgtttcctcgaccaacccgaggcgctgttcgatgaagcagggctgagcgatgaagagcgggatctgctgcgacgccgcgactggcgtggattgattcactacggggcgatttttttcgtgctggaaaagctcgctgccgtggtcggggtgccgaatctgcagatctacgcggcgatgcgcggacaaagcctcgatgaattcatgaaaacccgtaatcagcaggtgctctattcggtagcgggcaaggccccacgctaacgacacggcgtcatcggcggctcgttccgggccgcttcgcaacactcttgaatgacttcactgcgcccggctcatgcgggcgtagcggactgcttcatcccaaaaaaaatggataacaataacaatgaaaatcaccgccaatacccgcgtagtcttcacgctgtccgtcgtttgtgctctgcctgtcgaggcgagcgccgcaggctttgtggaagacgccagcgccaatctcaacctgcgcaacttctacatcaatcgtaatttcaccaacccggccaatgcgcagggcaaagccgaggaatggacgcagaatttcataacctgcgctggcgcaactcgagcattcgccgcgattacagcagcaatgccttcgacgagaatcgcttgatcatcagctatccgttgagcctgctttaaccgcttcattggcctgagttcggatcacccggcggatcatttccatcaacgcctgcgcgacgggtgagtgcaggcagccgctgcggtaggtcaggccaatggctctggcggtctgtttcagctccagcggcaaaatgcacaactcgccggacgcgatctcctgttccagttgatgcgctgaaacggccgcgagcatgtccgagcgtaacaacagtccgcgaatgatcgccatgtcggcgctttccaccaccggggaaggcgccggaatgccaaaaccggcgaagcagtcgtcgagcattttgcgcgccggagaaccggcgcgcggcaatacccactgcgcgttagcgagatgatcttgcaggccggttttgccgtagagcggatgatcacgccgcgcaagcacgaccatttcctctgtcagcagtgactcaccgaccaagtcgctggcataagtcgatgaacgcagtgcacccaaaatgaaatccacatcgccggcacgcaactcggtcgccagcaggtcgaagggactctcattggtgatcacttgaatgccgggatgctctgccatcaggcgcacgatggcctcgggcaggatgcgggtgcggccgaggggcagggcgccgacgtgcacaacaccgtgcaaggcaccgcgaagggcggtgatgtcgctgtcgatatggcgcagttcgttcagcgcacggcggattgcaaacaggatgtcatgactcgcgcgggtcggttgcaaaccacgcggcgtgcgctcgaacagcgattggccgcagccattttccagcactttcagcgtcgaactgaccgcaggctgactcagccccagcaggttggccactgtctgcatatgctgggtttcacagagtttgacgaacacttgcaggcgtcgtgcctggaacagataaagcggttcaatcgcggctttctcaccttggccgagcaatgtcggcacgctcccaagctccgccaatacccttcgcgcacggggtagcaagcgttcaccgaaatcggtcaggcgcataccgttggcgtggcgctcgaacagcatcacgcccagccgttcttcgaactcggaaatggagcgggtgaccaccgattgcgcccggtacagcgcgattgacgccttggagacgctgccgtgatcagccacgcggacgaaggcgcgcacgtgcatcaggctcggcagttcaaggttttccatgggcaagggctctgcgggtcggcgaattcgacgactatgccgccgctattttcgagtggcaataaaaaaaacgcatacctcgaacactcgaacgcattactccgtcggcggggtgcgatgcgatgctctttcgcaacgcaagaggagaatccgcaatgatcgaatcaaccaaaaacgcgctggttgtcagcgcccactcagccgattttgtctggcgtgccggtggcgccatcgccctgcatgcacagcaggggtaccacgttcacatcgtctgcctgtcgttcggcgagcgcggcgaatccgccaagctgtggcgcaagggcgagatgagcgaagacaaggtcaaagccgcacgtcgcgaagaggctcaggccgccgccgacattctcggggccagtgtcgagttcttcgatatcggcgattacccgatgcgcgccgacaaggaaaccttgttccgtcttgccgatgtgttccgccgggtgcaaccggagttcgtcctcagtcactcgctcaaggacccgtacaactacgatcacccgttggccatgaacctgacccaggaggcgcgcatcatcgcccaggccgaaggctataaaccgggtgagaaaatcgtcggcgcaccgccggtctacagtttcgagccgcaccagcccgagcaatgcgaatggcgccccgatgtgctgctcgacatcactgatgtctgggacaagaagtacgcggccatccagtgcatggccgggcaggagcatttgtgggagtactacacgcgcgtcgccctgcaacgcggtgtgcaagccaaacgtaatgtcgggatcacctcaacccgcaacatcgtctatggcgagggttaccagagtattttcccgcgtgtcacggagaatctgggatgagcgaacatatcggcaagactggcgttgtcgtgcgcaatattcagcgcgccgaagcagcgttaatcgatgagttgaaacgcttcggggtcgcgaccattcatgaagcacagggtcgcaaaggactgttcgcgagttcgatcagaccgattcaacaaggcacggtgatcagtggttcagccgtcacggtgctggttgcgccgggtgacaactggatgttccatgtggccgtcgaacaatgccggcccggcgatattctcgtggttgcaccgagttcgccgtgcaccgacggctacttcggcgaccttttggccacctcgctcaaggcccacggcgttcgggcgctagtgattgatgcgggcgtgcgcgacacccacaccctgcgcgaaatgggcttcccggtctggtcccgtgccatcagcgcgcaaggcacaattaaagaaacccttggctcggtcaacctgccgctggtgtgcggcgggcaactggtgcacccgggtgatgtggtggtcgctgatgacgatggtgtggtggtcgtgcgacgcgccgagctgcagcaagtcgtcgaagccagtcgcgcccgcgccgacctggaggaacagaaggccctgcgcctggccaagggcgaactgggtctggacatctacaacatgcgcgcgcgcctggcggaaaagggtttgcgttacgtcgacagccttgaagaactgggagactgagcatggcgcagacccgcattccctgtctgctgatgcgcggcggtacgtcgaaaggcgcttactttctggccgacgatttaccgcacgagcccgcgctgcgagaccgcgtgctgctggcagtgatgggctcgccggatgcgcggcagatcgacggcattggcggcgctgattcgctgaccagcaaagtggcgatcatcagaccgtcgagccgcgcgggtgccgatgtcgattaccttttcgcccaggtactggtggatgagccgcgtgtcgattacggtcagaactgcggaaacatcctcgccggtgtcggtccgttcgccatcgagcgcgggttggtggcagtgacagccgatgtcaccccagtgcggatctacatggaaaacaccggacagatcgccatcgcccatgtgccaacgtctgatggtggggtgcgctatgacggcgacgcgcgtatcgacggcgtgccggggcaggccgcgccattgatcgtcgaattcaaggatgtcgctggcgccagttgcggcgccatgttgccgaccggcaacgcccgggacgtgatcgacggcgttgaagtgacctgcatcgataacggcatgcccgtggtgctgatcagcgcgcaagagcttggttgcagtggctatgagagtcccgcgcaactcgacgtcaatgcttcactgaaacagtgtctggagtccatccgcctgcaagcggggcagcgcatgaatctgggtgatgtgagtcagcgcaacgtaccgaagatgtacctgattgcaccgccgcaggtaggtggtgcaatcactacacgcagtttcattccccatcgctgccacaccagcattggcgtgttcggcgcggtcagtgtggctgccgcttgcctgatcaaaggcagtgtggcggcggtcatggcgatagtggaggagggcgaggtgaaacgcctgtcgatcgaacatccgacgggcgagttcactgtggagttgcgcttgcaggacgagcgattgctcgggtgcggactgatgcgcacggctcggttgctgtttgatggcttcgtctgcattccatcagcgatctggaatgataaaaccgttagtcaatcaggagagtgcttctcgcagtacgcgtaaagagctgaaaaaacgcgcaagcgatccacccatgtggagcaggtcgcgcgtgcccagaaacgacaaagccctgaataatcagggctttgttgtatccagtggaagctcggcgggtgagtcgctttgatctgccagaccctgtgaaagctcgttgatcgatcgccaccttctttctgtcgaccatttttgtcgaactcatcggctcccgacactcgacagccacactcaagcacctgattgtgagtcccgggctttggatactggtaccggcaatgattgcgaccggtgcaagtggagtgttaatgagtcggaaacgacaaggacgactggtcgctttgaagaagaaacgcatgccattcattgccgccaatggccttttggttctgctgccgtgcgccattttgcttaaccaatgggcgtcggcgggaagtctggatacgcgtttttacttcgtgcaggtaattgaactgatcgcaggggccaccaatctcgcattaatggggatgaatatgcgtgacggcctgcgcctgagcggccgactgctgcgggttgcacctcacagacagtaagctgaatacttgcttccgtttgttttaaaagctggggcgaaatttgccattcgtgatcagctgctatcggccagaagcagcctgtcataagcgaaatgtttcggccccggagcggtcatttgcttttgcctatccaacgttttgtataacctcgggaaattcgtttcgaaccccgcattgcaatatccaggttcccgatatgcagacagaccaaaacagactactcgccctcgcattgctagagatcaagactttacttgttgattatctgggtagcgttgtagacgccccgacgaatgttcgcgtggcggcgcatattgcctatgcacttcataacgaggcggaggctgtttacaccaatgctgactttgcgctcgacgacgcatcccaaaaaatcgctgcgatcgatcaaattttaggtgccactgacggcgccgcgctattgggcagatttgatgtcgaaacctaagtcattccagataatgctaaaccaggatgactgcttttggccgatctctgcctgtcgtgagggccgtaatcggcccaaaacggagcctccaagcaagaatgtttgcgtcagctacgctattccaccaagcacgatactgaaagcgaggattgggatgacagttggccgcagagatgatctagcctattccatcctgttaatcactccggttctcctttacgccagtataggtgcgaacccgctgtatacaggcagtggttaccttgttgcagtccccgcagccgtgttcgtactgggctcgatttttcgaacgcctgccctgtttctgactggtacgacagccgcggcggtggccacactgtcgatctacatgaacatcatcgccagcctcgaccaccccgaagggttgtttgggctcgggcatgtgttctcaatgcccggcatgttggttggtgcatcagcgtcggcctggctgttgagataccgcgtgaaagcaagtttgccgtggatcgtcgcgggcattggctttctgggaactgccttgggattcatagtcgcccagatggttatgtgcaacaccctgatgtattgcggaccgctttcatttgggggttaacgcaggaaccgaacttccccttctggctgaaagcaggcgggtattaccttgtttcagctacgccaggaggccagctttcatagaaagagccgcctacaggtatcgggttgccatccatatggtatgcggcccatgccagtaggtgtgccatgcgttcggcagcaactggcgacagtctgcaatatcctctgacttcgtctagccgtactcggcaaacatcgaggtggcgtcgaaccccggaaaatccgccaagatagagatagaactcgtcgagaaggatacccacgcctggaacaccataggtgccggccacacctggtgcctcctcatatatggccttcacatcatggccttccaaggtcgcgacagcggttagtacatcgcaaaaagtatctttcatgctgttgctgacccagaggtcatagctgttgccgataatgatgggcgcgcccatgagtcttactctgatttcgataatggaatgctgaagaagagacggattcagccatgtcgccaattttcaataggccgtctccgctccgattattatcgttttgggctggaaaaggccatgcgtgggcggctgctcttggccgaaatctgtctttaacgacagccatcaacttcacgagtatccgcaaatatcagcttacgccccggctgacatccggtgatgctcgagcaagaagtccacaaacaatcgcacccgcgccggcatcgccgcgccaccaacgaacaccgcatgaatcggttcctggtctccggggttccaggcctccagcagcgcaatcagctcgccgcgctgcagatcctctttcacgctgaactctccgatacgggcaatgccggcaccgactcgggcgaattgtgccaacgcttcaccactgctgcattcgatgttgccgctgaccttcagggaaaacgctttgccatcgcggataaatggccagttgggttcggcacgcttgaaattgaagcgcaggcagttgtgctggagcaggtcttccggttcctgcgggacgccgtggcgctgcagatactccggcgatgccaccacgacctggccggtggtgccgatcctgcgtgcggtcagcgggctgtcgggcagatgaccgaagcgcaccgcgacgtcggcctgcccgccgagaatgtcgaccacttcgtcgccgagggtgaggtcgacgacgatgttcgggtaacgcgcgctgaaggctgcgaccaatggaacgatggccaggcgtccatgaccaagggcggcactgacccgcaatcgccccttgggcacgccttgatcggcgatggcgtcttcgacctcgtccatgtcggcgaggatacgccgggcgccgcgcaggaacgcttcgccctcggccgtgaaggtaatcgctcgggtagtgcgcaacagcaggcgggtgccaagccgttgctcggtgcgcgcgatgatccgactgactgccgagggtgtcaggcccaacgcacgtgcggcggccgacagactgccttcctgcgcgacggtggtgaacacgctcatttcacctgacctgccgttgaaatccacttgtgcctcctacgcaaaggtgattgccaaaaacgctatctaccgcctgaaaggacgggatcgtagcattggcagcatagatgaggagctttccatgcgtatcaatccaccacttgttgcactcgccatcggtgccttcggcatcggcgttacagaattcgcccccatgggcatgttgccgggtatcgctgcggatctgggcgtttccattcccgctgccggtttgctggtcagtgcttatgcgctaggcgtattgctcggcgcaccactgatgaccctgaccaccggcaagattccacggcgctatctgctgatcgggctcatggcgattttcaccctgggtaatctgatgtcagcgttggccaccgattactacagcctgatggtcgccagggtcgtgacctcactgaaccacggtgctttttttggcgttggctccgtcgtcgccgctaccctggtcgccccggaaaaacgtgccggggcagtggcggcgatgttcatgggcctgactctggcgaccatcggcggtgtgccgctggctgcctggtttggcgaactgttcggttggcgcaccgcgttctgggggattaccggcctgggcgtagtgaccatggcagcgttgtggttcgctctgcccaacgtgcgggcgccgcaaagtgtcggtgtcatggcagaaatccgcgtactggggcgcggcccggtgctggctgcgctggccctgaccgtggtcggctcgagtgccatgtttaccgtgttcacttacatcgcaccgattctcagcagcgagacccatgcatccaccgcttacatcaccgccatgctgatgctctacggtgtcggtttgacgctgggcaacatgtggggcggcaaggccgctgatcgctcgatcgatcgcaccctgatcgtctcgctgagcgtgctgattctggtcttgttggcgttcaccgtactgatgcgctggccgctgccggccgccgtggccatcctgatctggggtattgccagcttcgccctggtgccgccgctgcagatgcgcgtcatggaagcggcgaaggacgcgcccaatctggcctcggcggtgaacatcggcgccttcaacttcggcaatgcgattggcgcagcgcttggcggtgcggtgatcagcagcggcctgggttatccggcgatctccctggccggcgcggcaatggcgggcctggggctgctgatggttttggggtttgcgtggcgttccagaacggttgaagctgcagtggtgtgactagctcgcggtcagcctgaacaaccgagctggcgtagcgacaaaagctcttgatcgaggcccgctctggcgggcatctttgtctgccacgtcaaagcgtggtgatctgcccgttgcgatccagttcatacaccttattcccctgcaatttctccttcagccaccgctccgctttacccagcggccgttgccgcgcccagagcaaatccacaccaatctgccagtcggtatgcggatacgccgagagctgcagttccaccagttcccccttggccagttcacgctgaacaagctggcggggcagggtggcccaaccgagcccggcgcggaccatttccaataacgccagatagctttccgcctgccacaactgggtcgagcgcaggtattcgctgctcggcagtttgctcgcgtgggcgctgaaggccaggcgccggtggacgtgcaggtcgtcgaagctgacgttatcgagttgcgccaatggatgctcggggtggcagacgtgcagcatgatcagtttgcccagttgctggaacgccagttccttggggtagccgggctgcgagaacgccacgccgagtaccgcttcgccgctgctgaccagttcgctgacgtcgccgtacaccggatggcggatgatcaggtcgacgaaggggaacgcggcttcgaaggctttgagcaccggcatgatcgggccgtatggcgtttcaatcgccagtgtcaggctggtttcgacgttgtccgaaaggcaatcggcgtgggcttcgaaggtcatgcagcgttcgagcacggcttcggcctgcaccagcaatttgtggccgctggcggtcagggcagggctgcggttgctgcggtcgaacaggtcgacgccgaggtcggtttcgaggttggcaatcgccgcgctgatggtcgattgggtcttgcccagtttgcgcccggcggcggagaacgatccgcttttgaccacttggacgaacatcaacagttgatcgagtgagaagcgcaagcggtgaactcccgagtcgaaaataaaggtttggagcggctaacgaatgccagattcgtgccatcgaaaaaagcgatggttgctaatttttttcatcgcaataaacgttcaaatatgccctcgcgtcaaacgatctccggggcggatctacctttcaaacgcccctgagcacccgcgatctcaacagatgccgcaccttcaggagcgtgtgaaatgaccacacaacgcattcatccggtggacgaagttttgccactgcgacagttgttcacgtttggcttgcagcatgtgctggtgatgtacgcgggagcggtggcggttccgctgattctcggcagtgcgatggggcttaccgcggcgcaggtggtgttgctgatcaatgccaacctgttgacctcgggtgtggcgacgttgattcagaccctcggcttctggaaattcggcgcgcggctgccgctgattcagggctgctcgttcattgccctggcgccgatgatcatgatcggcaaggaattcggcctcagtcagattttcggtgcggtgatcgccgctggctttatcaccattgccctggcaccggtgttcagccgcttgctgcggttttttccaccggtggtgattggcagtctgatcaccattatcggcatctcgctgatgccggcggcggcgatctggctgggcggtggcaatcccgactcggcggatttcggcaatccggcgaacttgttgctgggtttggccacggtcagcgtgacgttggtgatctacgccaaatgcaagggtttcctcggcaacctcagcgtgctcattggcctgtttgtcggcagcctgatcgcagcggcttgcggcatgactcacttcaaccgggtcagcgaagcggcgtggtttgaactgagtgcgccgatggcattcggcgcgccggaattcgcgccggtgccgattctgatcatgaccctggcgatgctggtgatcatggccgagaccaccggcaactgcctggcgatcggtaaattgaccggcaaaccgaccacgcaacagaccctcggcaacgcgtttcgcgccgacggtttgtcgaccatgctcggcggcttgttcaacagttttccttacaacgccttcacccagaacactggtttgattgcgctttccaacgtcaaaagccgcttcgtcgtggccgctgccggggcaatcatggtgttgatgggtttgttcccgaaactcggcgcgctgatcgccgcggtgccgacgccggtgctcggtggctgcgcgatcgtcatgttcggcatgaccacggtggcggggattcaggaactgtcgcgggtgcaattcgagggcacgcgcaacggcattatcgtcgccgtgtcggtgagtgtcggcgtcctgccgatgtcctttccggcgctgttcgaacacgtcggcccgaccctgaaactggtgctcgacagcgggatattcctcggagcgatcaccgccatcgtcctcaacatcctgctcaacaacgataaaaaatcgaccgaaaccatcggcgctgaactggccgactgacttttgttttccactgcccaggagttacccatgaatcaattcactcagctcatcccggccggcgtcagcgagcttgatctgacgttgctgcgccagaccatcgccttgtccgaggcatcgaaacaacgcggtcgccatccgttcgcggcattggtggccgatcgcaacggcaaggtgattgtcgaagcggggaacaactcgatgccgccgcaaggtgatccgactcagcacgcggagttggtggcggccgccgctgcggcaaaactgctgtcgccgcaagagctggaactgtgcacgctgtacaccagcgccgaaccttgctgcatgtgcgccggcgcagtttattggaccgggatcgggcgggtggtttatgccttgtcggagcatgcgctgctggggttgacgggcgaccacccggagaacccgacgttctcgctgccgtgccgcgaggtgttcgccaaggggcagcgcaaggtcagtgtgttggggccgatgctggagggggaggcggctgagccgcataaaggcttctggtcgtaaactgctgtccgcttcacaagggccagcgaagcgcaaacagcaaagggcttgaatgccgcgcatcctcggatgcgcggcagactatcgtttcgacactcacgaaactatcgcgagacgaacctcgcttttacaacgcaaacgtagtcccccgagtattcacaaacagcgaatagatcgagtgactgctggccatgaacaaccgattcccttcgcgtcccccaaagcacaaattcgggcagcgctcaggcagcgaaatatgcccgatggccttgccctgcggattgaacacgcgcacgccgtcgagtttttccaggtcggccttggggtcgccattgccgccccagccgcaccacaggttgcccgcttcgtcgcacttgatgccgtcgattgcggcgtattccagcccttcgatgtgcttgcggcgttcgcccagtgtgccgtcgtccttcacggcaatcgcccagatcaagcgattgggcttggcgcgaccttcgacgacgtagagggttttttcatcgggagaaaagcacaggccgttggggccgttgaggtcgtcgatgacccgcgtgacttgtttgctctcgccgtcgatgcggtacacggcgtggggttggctcggggtgatcttgtggccttcatagttgttgccggtctggaacggcgggtcggtaaaccagatcgatccgtcacttttgcagacgatgtcgttgggcgagttgaagggcttgccgtcgaagctgtcggccaaaacggtgatcgtgccattggcttcggtgcgcgtgatgcgccggccttcgctggtggtggtggagccttcgcagacgatcagacgtccctggcgatcccggcacatgccgttggagaaattggagtgttcgcgatacacgctaaaggtatcggtgatttcgtcccagcgcatgatgcgattgttggggatgtcgctgaccaacaaatagcggccatcaccgacccagaccggtccttcggcccagcgcataccggtggcaagtttttcaacactggcgttgaaaatacgtagttcgaggaagctgtcgtcgaggatatgaatcagcgggtcagggtagcgctgactcaagggttcggcggcctcggcgatccgcgtcagtgcggtgctgccgacggtggcgagcgtggcggaaacagcgagggactttttcaggaagctgcggcgggtattgcctggcgctcggtcgaggcttgcaggcgtggcggacagggatgaggccatgtagcgatctccgtggttttattttttttcggggagacgtagtaataccttgtgataggacatcgtacaagttgttcgttgcgcgacgccaatgggcgtcggtagcggtggaaagccagtgagcatcatgacctccaccgtagaattggcatgcgataacttcgtgtcctgcgggcaaggacagcttttagtcaactatcacctcatccagagcctgctccagcaggctgaccgtacgctcgatattctgcagcttctccagtccgaacagaccgaggcggaaggtctggaagtcggccggttcatcgcactgcaacggcacgccggccgcgatctgcaggccgtgatgggcaaatttcttgccgttcttgatgtcggcatcatcggtgtagctcaccaccacgccaggcgcctgaaagcccgcagcagccacgcttttgatgcctttgccggtcaacagggcgcgcacccgatcacccagcgcctgttgttcatcgcgaacgttgtcgaaaccgtaggcttgcgtctctttcatcacctcgttaaagcgcgcgagggaatcgctgggcatggtcgcgtgataggcatgtccaccctgttcgtaggcctgcatgatctgcagccactttttcaggtcgcaggcgaagctgctgctttgcgtctgttcgatacgctcaagcgccgcagaactgaacatcaccagcgcgcagcaaggggaggcgctccagcctttctgtggtgcgctgatcagcaggtcgacggcgcatttgtgcatatccacccaaattgtgccggaggcgatgcagtccagcacaaacagaccacccaccgcatgcacggcgtcgccaacggcccgcaggtagtcgtcgggcagaataatcccggatgaagtttcaacgtggggcgcgaagaccactttcggcttctgcgcggcaatggctgccagcacttcgtccagcggcggcggggcgtaggctgcctggcgccccggctctaccggccgggctttgagaactttagtgtccgccgggatgttgcccatctccagaatctggctccagcgataactgaaccagccgttgcgtatcaccagacattgctggccagtggcgaactgtcgcgccaccgcttccatgccgaaggtgccgctgcccggaactactgccaccgcttcggcgtggtagacctgtttcagggtcgtggaaatattcttcatcacgccttgaaaggactgcgacatgtggttcagcgagcggtcggtgtagaccacggagtactcgaccaatccttcgggatcgatgctcggatagagctttgacatggtgactccttgggcagagaggtaaatatcattggcaagcaagtgtaggcaaagggcagggaacagctcattgattcgcgcaaatgaggttagagtgctcggcaatgtctcaatcgttgcgtgaaccatgaagctgccgctatttatttctctggatgggcccaagggcaccggcaaaaccacactactggaggccgtgaccgccgcgctgcgggcagaccagcataaagtcatccggctgtgcgagagaaaaagcgatccctaccgcggcgaaaccatggcgctggtcaaccaactcgccagacatccttcccgggatctggagtgggcggtgtgtcagcgccttgcggagagccgtcgctggatttctgagcgggtgctgcccaaacagccgttggacagcatcatcctgatcgaccgctggtatccgtcagatgccgcatttcgccacagcgtgccgtttgccgagattctgcagttgaacatgcagcgaggcgtgcgcgttccggatctgcacgtcggcgttgtcaccgcacctgatatttcatgggcgcgggcaacggcacgctcgcggggactgggcggcacggtgatccagaaacacgcagagcacgttgtgtgtagcgagatgttcgaaaaagcggttgccgatcacggctgggtgttgtgccgtaacgaaggaaccatcgaagccgcgacgactcaggtagttgcagagatctataaggtgcttggctgattgtcgctgcccaggcgctggttgaatttgaatttcaggtttctctgatctgagctaaccgtactgacggatcacacgccccccatgcttacaaacctctggtatgtcgttctcccatcgtcgcagttgactgatggactgatgccggttcgattgctcggacaaccgttcgtggcgttccgcgatgacgcgggtgtcgctcacctgctctcggatatctgcgtgcatcgcggcggctcgctgtccgccggcagcaaagtgggcaacagcgtgcagtgtccctatcacggctggcggtttggcggtgatggtgtctgcacgcagataccggcgcagcccgacctgcggattcccgccaaggcccgcgtcgatgcgtacccgacgctggagcgctacggttggatctgggcgtttttaggtgatctgccggagtctgagcgtccaccgttgccgacgctcgactggatcgacgatcccgccatccgcgtggtctcgggccactttgactggcaggccagttgggaccggattatcgaaaacggtctggacttcgcccacgcaccgtttgtccatggctcaaccttcggcgatccggatcatcccgagattgaatcattcgaggtcgacagcgatgcatggagcggcaccgcccagatgctcatgcgcaggccagcacgcaaagggctgctgcggcgcaaatcctccaccgagtttgtcagtgtggtcaccgttccgggtttccatttgtccgggccgtgcacaacgcttgaacttgagttacccaacggctggcggatctacatcgtctcggcgcatgtgccgattgacgccaatcgcacgcgcacctggtggatgatgggcagaacgttcctgcgctcgcgactgctggatcgtcggttcgttgccagcaatatccgcatcttcgaacaagaccacgtcgtgcttaaaaacgtgcggcccgagcgcgtgccggactcctttcagcaggaggtgtcgttgaaatccgacgcactgcagattgcattccgcaaagacgtgcaggcactggaacagcgcggctggcgcatcgatgaagagcgtcttgcgcgaaccttcaccgggcgcaaggcctgcgcagtgcccagccctgaacgtggtcagattcgcgcttgggcgatcgagccgattccgcttctggacatcagccaagaagaggaatgactgttcctgagggcatacatcttgctttgctaacaaaaactattccgatagctagcaaagagagagcctgcaaccatgatcgcaacctccagtcgtgcggtgatctgtacgcctcatgccgaagccagcgccgccggcctgcggattcttgaagcgggcggcacggccatcgatgccatgctcgcggccagtgccatgctcgccgcagtgttcccgcacatgaccgggctgggcggcgatgccctatggatgatccacgacaaacaagtgcgcaccatcgtggggattggccaggccgggcaacgtttgccggagggcggaatcatcaccgtgcgcggtccggcgtcggtggccagcacagcaggcgcgctggcgagttggcggaccgccgccgacatcagtcgtcaccagtggggctcacgactcggttggtctgatctgttgacagacgccgcgagcgtggccgatgccggtatcgaggtttcgcgatcgcaactgttctggcaaaccctgcggcgcccgctgatcaagcaactgccggacctgcatcggctgtgcaagcgcgatgggcagtggctgcgcgagggcgataccctgcgccaacccgaactggccaacaccctgcggcatctggccagacacggcgtcgaggatttctatcacggcgaactggccgaagctttcggagcagcctttgatggcctgggctgcggcttgacgacagccgatctggcggcgacccgagcgccggaagtcgcaccggtctcggtacgctatcgcgctggccgcctctacaatgtcgcgccgccatcccaaggtttgtacacgttgcaggccatggccgcgctgcaacacaagccgctggcagacgttggcaacggcagcgcgctttactatcactatctggtcgaagccatcaaacaaggcttgctgcggcgcaatgcgcagctgtgcgatccgctgagccaaccgtgggatttcgccgccagcctggaggacgcgcagattcaggcgtatgccgctgccatcgatgaccggcgtgccgcgccgtggaacgagccggggcgacctgccgataccgtgtggatggccgcgaccgatgccgaagggcggacggcctgcctgatccagagcctgttccatgacttcggttcgggctgcatgctcggcgacaccggtgtgttgtggcagaaccgcgcggcgggtttcaacgccaaccccgaacacgtcaacggctgggcgcccggcaagcgtccggcgcacacgctcaatccttcctgctatctggctgacgatggccgccgctggttcttcggcacccagggcggcgatggccagccgcagacgcaaatggtcctggcgacgcaactgatcgactttcagcagcctgttgaccaggcgctgctgaccccgcgttttctgctgggtcgcagctttttcgacagcacggacaatctcaaactggaaggcgatatgcgcgccaccaccattgaaggcctcggcctgctcgggcatgcggtggagatcattccggtgcgcagccccatgaccggccacgccggcattatcgctattgatgccgaaggtcggcgcagcgccatgcatgatccacggggcgagggcacgggactcggccaggtggactgacctttgctatgggcatttgccgggccccggcggctggcggataatgccggccattgcccgccaaccgcagttgtgtggattggccggctttctggacaacagaggtaaggatgggcttgagcactgtcaccgccaaacagcttgaggtgcaacgtatcgtcgatgcgctgttcagcgcgatcgcccagcatcgactgccgccgggcactcgactgatcgaagcgcaaattgtcgaaaccctgcaagccaaccgcaatcacgtgcaggtagcgttgcagcgtctggcgatgcaaaaagtggtgaccatcgaagccaatcgcggcgccatggtcgcccagccaacggcacgcgaagcacgagatattttcagtgcgcgtcgcgccatcgagcgggcgattgtcgaggcgatcacaccggcaaccatgcgcaagcaacggcagcgcatcgccacccacatgaacaacgaacgcaaagccaccaacgacactgatcgccgcgccatcgtccgcgagctcagcgagtttcacctgctgcttggcgagatcagtggcaatgccgtgctcagcgacatcctcgccaacctgatggtgcgcagttcattgatcgtcgcgctgtatcagcgcaatgacgtgccatcctgcgcttccgatgagcaccaggaaatcatcaccgcgctggaaaatggcgataacgaaaaagccgtggcggtcatgatcgagcatctggatgaactggaagcgcagttggcgctggatgaaagtgtgcctgccgagttcaacctcaagcaggcgttgattgattaagtcgctttcatcaacgttgccgccggccggctgaacgtctggcgtccgcccttgaagcccatcagcggtgcgcttatttcggcgatcaccgccgctggcgaaggcgcgtcgaacacaatgaaatcggcgcggcaacctgggcgcacaccgtaatccttcaatctgagcagcgcggccgactcgctggatacccacgccaggcattgcagcaattccgccaccgtacccatctggctgacgttggcgaacaggttggcctgacggatcaacgacgcatcgccatacggcgtgaacgggttgccgatgttgttggtggaaaccgagcacctcacgccgcacgcttgaagatgcgccagcggcgccagccctcggggtttgttgtgaaacgcctcgcggcccagcaaaaacagatcggtgcttggcaggcaagtcacctgcacgcctgctttagccagatgcagagccagcaccgtcagtggctcacggggcagcgtcgacagcttggtcgcgtgaccgatggtgacgcgaccaccccagccgtgcagctgcgtgcagcgtgccacttccatgaccgtcatgccctcgctgttcaggtcgaaatccaggtgcaggtccaggtcgcagtcgtagcgcactgccagttcgaacagacgctggatctgcccgtgcgggtcgctgtccatgtaggggcagccgccaagtacggtggcgccgctttccagagcctggcagagcagcgcttcagttcccggattgttcagcatgccctcttgcggaaatacacagatttccaggctgatggcccaggcgtaatccgcctgcaaacggcgaatcgcgttgaatccggtcaggccaatctgcgggtccagttcgacatgggtgcgcatgtgcgtcgtgccttgcacgatcgccttgtccagcacctgcgcaccgcgctgatagacatcgtcttcggtgaactcggctttcgccgcgcgggtttgcgcgacggcttcggccagcgtgccttcctgcagatgacagcgctgcatgatgcaggccttgtccagatgaatatggctttcgatcagccccggcatcatcaggcggccttgcaggtcaagggtttgccaagggctgacggtcgcgctgaagcggtcgacaaagtagccgttctcgacgtaaagctcagtcacgcggtgatcgctgcccagccgcgcattgatgattttcagagcgctcatgcgctggccccttcacccagataagcggctgccaacgctttatcggcgcgcagttcggtggagccggcggctttgacaatggtcccggtttccaggacataagcgcgatctgccacttgcagcgcgaggttggccatttgatccaccagcaggatggtcacgccctcgtcgcgcagggcggccagtgcgtcgtacaactcgccgatcatcgcgggcgacaaacccagtgacggctcatcgagcagaagaatgctgggcttggccatcaggccacgacccacggcgaccatttgttgttcgcccccggaaagcaggcctgccgggttgtcgatgcggtcgcgcaggcgcgggaagcgcttgaggatggcctcgatttcagcctcggcatcgaaggactcgcggcgcgaatagccaccgagcaacaggttgtcgcgcacactcaggtaagggaagacctgacggccttccggcaccagggccagacctttggcggcgatcgtgctggcgctggccagttcgatgttttcgttgtccagcacaatgctgccgctggtggcgcgatgcagaccggccagacactgcaggatgctcgattttcccgcgccgttagcgccgagaattgccaccagttcaccgggattgaccagcaggttgaccttgtcgaccacggctgaggcgccgtaatcgatcaccagatcctgcacgtacaatcgcgcatcgcggctgccgttccaggcttgcgcgcgcggtgtggcttgatactcggtaccgcccagatacgccgcgatgacctgcggattttgccggatttcagccggcggccccgacgcaatcggcttgccggcgtcgagcaccaacagctgctcagacaccgacatcaccaacgccatatcgtgctcgaccagaatcactgtcaggccaaagtccgccagtttgcgcagcaataaggcgagatcatcggtgtcacgacgactcaggcccgctgcgggttcatccagcaacaacaccgcaggcgccgtggccagtgcgcgggcgatttccaccaggcgacgatcgacatgaggcagatcctcggcagcaatattcacttcgccgcgatagccgaccaaggccagtagatccagggccaagctgcgttgctcggtggtggacaggctgaacggccagcccatgcgtccctgctgcatcgccaccagaaggttgtccatgaccgacatttcgccgaacagcaaagtcgtctgataggtgcgagcaatcccggcccgggcgctcttccaggcaggcagccccgccagcggttgttgcagttcgatctggccactgtccggcacataaaaaccgctgatcatattgagcacagtggttttaccagcgccgttagggccgatgatgctggtgatgctgccagccggtgcatgcaggctgacgtgttgcgccgcctgcacgccaccgaagcgaatgccgatatcgctgacgcgcaatccgcaattcgggccacggctgcgtagatgcgcggcaatgcgctgctgattgaactgcgtgggtggcagcaagcgaaccggtttgctccagcgtcgggcgagggcgcccagcagaccgttgggtgcgatccatagcaccaacagcagcaaagtggaaaagatcagcaagcgatactcggcaaaatccgacagcaactccggcaccagcacaatcaacagcgcgccaatcagcggcccgaacaaccggccgctgccgccaacaatcaccgccagcacaaacagaatcgactgcgaaaacggaaaggattcagggttgatgaacatcagcagcggcgcgagcaagccgcccgccagtccggtcaaagccgccgacaaggcaaacgccagggtcttgctgatcaccggattgaagcccagcgagcgcgcggcaatttccgaggctttcaccgcgagcatggctttgccccagcgactgtggctcaggcgctgaaaaaagagcagggcgccaatcatcagcgccgccgccaacgaagcaaggaagattgacgggtcgaggccggcaaattccggcatcgggatacccatcaaaccgttggagccaccggtgacgtcacgccattcgatcaggctgtgatgcaccacaaaagcaaaggcaatggtgatcatcgccagatacggaccgctaacgcgaagggcaggaattgccaacagcgcgccaatcaccccggccgccacaccagcgatcggcagggccagccataacggccaacccgccaaggtcagcagtgccgagacataggcaccgatcgcgtagaaggcgatatggccaaaggaaatctgcccgctgaggccgatcagaatattgaggctcacgccgaccactgtcgccagcgcgcacagggtaaaaaccagcaatgagtagctgtcgagtgtgaacgccatgacgccacacgcgacagcgagcagggcgatgagcagagtaggcatgcttttcatactttcaccaatgcctggctgccgaacagaccgttgggacgaatcgccagcgcgacgatgaccaacgcaaaggtaaagatctgcgtgaaggccgagccgaaatacatcgtgatcagcgcttccgtcagaccaaataacaggccagccgtgaagacaccgccggcactggtgatgccgccgagaatggccacggcaaaggctttgaggccgaacaacatgcccatttccgcgttgacgctgaacagcggtgcaatcaacaaaccggccacggctgcaaataccgtggaaaccgcaaaggcaatggcgaccacccgattgacgttgatccccatcagcattgctgcgcggggattctgcacgcaggcttccagcactttgcccagccgggtgtaacgccgcaccagatacagcgccagggcaatcgccgcgcctgccagtggaataagcatttgcagggcgccgacgttgctgccaaacagctcgacattcaggttggccagactgctttcaaactggcgcggctccttgccgaaggtgaacagcgcgaggttgtccaccagaattcctccggccaccgtcgccatcagccaggcctgtgagccacgactgtggaagggccgtaccagccagcgttcaattgccaggccatagagcgcacagagcaacaatgtcagcggcagcgcgagccacagcgaccagccccagttaatgcaaaaggtgtagcccagcaccgcgccgaccatcatggcgctgccttgggcaaaattgacggtgcgcgagacgacgtaggtcaggtgaaaccccaacgccagcaacgcgtacatgctgccgaggccaagcccggagatgatggcggcggtgtacatggcttactcctcaggcttgagcggcacgatctggtcgttgacgaagtgcgtgaacaggtaatcgtccgggcctaacgcgtcatgctttgctggggtaaagggttgctggtagtgcttgatcaagccggcgtagtcgctgatggcgtaaaagccgtcgcggatcgccttgccgtcggtactgccggcttttgccatcgccagagcggcgaggtgcagaccgtcgtacgcattggcaatgccgaccgctggcgtcacgtcggccagcgtcttgatctgcgggtaagccgttttcaacgcggccaacaaggcgtcgcccttggcgctgttgtgctcggtgaaaacgtaggtctggatgaaatgcacgcgcgatgcattcggcccggccaactcaccaaaacgaccaccggccggcccccagtgcgagacgaccggcacgtcccaacccatgcgatccaaagacttcacgacttgcgcggaagggctgacgttaccgacgaggaggagggtgtctgcaccggcgtttttcaagcgggtcagttgtggcacgacatccagatcgctgtcttgaatacgctcgacaccggcgctggccatgccacgtttttccagggcgcgcttgaggccagcctcgttggactcgccccacgggttgttgatgaggatcatccccggcttcttcatgccgtggtcgacgccgtatttcaccagggcttcatcgaccagctcatcgacggcggaaacccggaatacgtagttgtcggcggcgccgttctcggtgattttcgtccccgccgcccagatgcccatgaacggcactttcatctggttgaccaatggcacgatggccagggaaaccggcgtatcgaggccaccaaacagcaccgcgactttttcgcgctggaccagttcacgagcggcgaggatgcccttggacgggttgctttcatcgtcgcgacggaccagttccagcgggcgcccgagcacgccgccactggcattgacctcattgatggccatggtcaaaccgcgagtcagggcttcaccggacttggccgactgccccgaaagcgcggcgaccagaccgatcttgatcggcggctcggccgcttgcgcgccaccggacatggccaggttgagcgtgactgccgcagccacgggaaacagcagacgctgcaggttttgaagccgagtagccatagttgattctcctgattgctagcagttataaaattattgctagcaagtagggtgccactcggtctggctatcaaaactccggcttttgcagcgttgtgtggcgagttggcgctccaaatggaggcgttctgcaccacacggaagcgcgtttattgctgcggcgctggctcaccactcaaggcatcgaccatcggcggacgttcctgcaccgcctgtcgcaagtcttcggtcacccgcagctcagcgcccgtcggcgagaacgttgccgccgctgcgaacggcgcgggattggccgggaccgggcgtttgccacgtcgccacagaaagaaagtgaccatgcacagattgaccagtgcgaagacccagaacagaccattggcgccgaaggaattcatcaccggcgaaatcatcatcggactgatcgccgaacccagcgagttgatcaacagcaagccctgaatcatcggcaccaatgcttcggcaggcgcacggtcggcggcatggctgacggcaaccgggtacagcgcaaacacgccgccaccgagcagaaacagcatcaccgcgagcattgtcgaggacaacggcaacagcacgatcaccagcgataacacggtgcacgccaccgtcagaatcgtcagcacctgcaggcgatccttacggtcggaccaacgcccgaccgggtattgcagaagcatcgcgccgaggatggtccaggccatcatgctgccgacttcactgacattcagcccggcgcgttgcaggtatagcggcagcaaggtgtagatcgccgcgatggtgacacccgagccgaaacagccgaccagcccggtcggcgtcacgcccaacagttgtcgaggcttgagcggttccacctgatcgagcagcggcgacacgcgcggcaggatcacgatcggcagcaccgacaacgacgcgagcatgccggcaaccatgaacggtgcgctgtcgctcaacccggtgatttttcccagcgctgcctggcccagtacaccggcgccgtacaagacgatcatgtacaacgcgagcaagcgcccgcgaatcttcgcgtcgcccgccaacagcagccagctttcgatcaccagaaacacgccgaccgtggcccagccattgatcaggcgcagcgcgaaccagccccaagtgtcatagaacaatccctgcagcaggatggtcacggcgatcagcgaagcaaagctgccgtaggcgcggatatggccgatacgcaaaatcaagcggtcattgaatacggcacccagggtcagcccgatgaagtaggccgatgaaacgacgccgatcatcgtcgctgaagcgccggcagcgtccagtcgaagggtggtcagcgaagacaggaaaccgttgcccagcgcaacaatgaacagcccgagcaggggcgccagcgccatggccagcaaaagcggagacataaaaacctcaagagatcgaacagcgcaacgtgcgcctctgcgcatgcgattgccaagccggggtgtgtggtgcgggtgcccgccgaacgggcagggcggttgggtacgctgcggtcaccagatccggcgactgcgagagcgcgcgggattctaaggcctgtggaggatttgccaagacctgtttgctgcgacgcttggacgcaggcaaacaaaggctgagtcataacgacagctcatcgtttgcagggcaaaaatgttcctttattgatgctctttcgctggttagcctgtgcggtcgagttgccattttgtgccaggagtcatgatgctgatcaaaggtgaacgggccgccacagggtgtggtttggtggcgattgttttgtggagtaccgccgccggattgatcaggggcgtcagcgagcacttcggcccgctgggtggcgctgcgctgatctattcgctgggcgccatgctgttgctggtgttcctcggccgcccgcggattcgttcgacttccaggctctatctggtgctcggcagcgcattgttcgtcgcttatgaggtgtgcctgtcgttggcgctgggtttcgccagtgatcgccatcaagccatcgaactgggcgtggtcaattatctgtggccgtgcctgaccgtggtgctggcgatcgtcatgaacgggcagaaaacccgctggttcatcattcccggctccgcgctggcgattttcggcatcttgtgggtggtcagtggcgaggggttgtcgctgccggggattgtgcgcaatgttcagtccaacccgttgagctacagcctggcattgacctgtgcgatcacctttgcgctgtattgcaatgtcacgcgtcgctatgctggcgggcagaatctggtggtgctgtttttcgtattgacgtccgtggtgttgtggttgaagtggtacctcagtctcgaacagattccgccattcacctgggcaaactctttggaactgctggcggcgggcatcgccatggccggtggctacgcactctggaacatcggcatcctgcggggaaacctgaccttgctggcgaccgcgtcctactctgcgcccgtgctgtcatcggcgttcgccgcactgtggctgggcgtcagtttgcagatgcaattctggcagggcgctgttctggtgacggtgggctcgctactgtgttggcaggcgacccggcagcacaaggtttcccaggcaactccgatcaaggtcagcgtgggcgaaccccctcactgaaagagaccttagcggtcaccccttgcctgatgctaaattgcggctgtcacaagtctcccgcaattgagtctcgacaggctcagagaaattcagtgttgatgctcttttatgtgcaaaagaagctggccgaagcaggccagaaaaacgccagtgcaatggctgatcaatagtggggactgaaatttagaatgcgccgcttaatagctcatggatgtgttgttgtcagtatcgcgatgctgtgttcaggatgtacctcctatgcgaccgtgccgacaatcaacgagcgagccggaaatggaacacaggaaatcatctccagcttcagttacgaaatagactctccctggaaaaacagtcgccttggcaaagacgcctatgcgctgacaaagaacatgattccaaatgcacaggatctcagctccagccccacagcctcgagccgccctgcactggaaataaaaatctcggaattttcattgggtggcgcttgcacgcaagagtatttgacggggttgagttttggtttgattccgagttggtgtacaaggccagacctgttcaagtttgagttcattctgaataaagaaaacggcgtttgcaggcaaacaacctattcagtaaacgccacaacggtttcacatctcgtggtgattccatttgcactgtcgcagcccgacaagcgaccactgaccctttatcaggcttcgctaaaagatttccttcaagcagatcaatgttccaaaggcttgtgaccagcgcatcaggctttcaaaaatctcgcggcgtaactgacaaacaacagcagcaataccagcccacccagtgcgataaccagcgaactgaggtgcgcaaccatgccgataaatgccggccccatgagaatgccggcatagcccatggagatgatcgccgggatggcggtgcgctggggcatgcgctgttgccggcccgcggcggtaaacagcaccgggacaatgttcgagcatccgataccgaccaaggcatagcccagcaatgacgcctgccagctctcgaacaccagcgaaaccagcatacctgccgccgcgcagatcccgcccagcgccaccacgcgaacgccacccagtcggctgacgatggcgtctccggtcaggcgcccgagcgtcatcgccgctgcaaaactcgcataacccaagcctgcatagctgggttccatttcgcgttgcgaggcaaggaaaaccgcgctccagtcgagcatggcgccctcagtcaggaacacaatgaagcacaggcagcccaacaggagcacgatccctcgtggaattgccaacaacgggccatctctctcggtaccatagggcagcaaacctggcgcagccttgtacagcgcggcaaggatgatcgccaccagacacaacaccgacagcagcggatccagccccaggctgagcatcgccgtcatggccccggcaccggcgatgccaccgacactgtagagcccgtggaacccggattgcagggtttcgccgctgttcttttcaacaatgatggactggatattgattgcgcaatcgagcatgcccatgctcgcgccgaaccccagtacggcaagtgccagccccggcagccaggtcagatggctgagcatcggcagcaccgagcacaacgcgagcgttgagcagatgatcaccgggcggcagccaaaacgtgcggtcaggtaaccggcaaatggcatggcgacgatcgagccgataccaaatcccagcaacaacaggcccagtccaccgtcgtccagccccgtgcgcgctttgactaacggcacgagtggcgcccaggccgacatcacgatgccggtgatcaagaatatgatgcgggtcgacacgcgttcgccgtagtttgcataagtcgccacggatgatgtcggggtgttcattgaggcggacatccttatcggtgtctcccggcttttttggctacaagccggaataacagcttttcgaagcaaaagagtcccttccagcatccgtcgggatgctgaagggagcagggttcgcataagtgaaccgagcgcagatcagccaacagacttcagcggaatcgggcctttgagccgatccatcatggtcgcgcagtaccagtcatcgaactgacaaacgccggtctcggccgtttccgaataaggacccggttcgtacgacggcgatgtcacgccccgctgggtgccctcgaccagcgtgcggtcctgatcgttggtggcaatccagactttggtcaggcgatcgatatcgtagtcaacgccttccaccgccgtgcttggaaccagccacttggtggtgaccaatgtttccgtagcgctgatcggcagcacgcgaaagctcaacgcgtggtcaccgaggaagtgattccaggtggaggggtagtggaagtacagcagcgcgccgatgtccgcttcagaagtcttgtccaggcgcccggcaacggccggcttgccatccatggtgtagctgacggcaccggatgacagcggaatacgggtcatgcggaactggccgttgatatccatcaccaaacggcttggcaacccggcgctctcgcacttggaccagtaagccgagagttcgggatcatcttcgccactgacgccacccaccgacaggttatcgacgaacgagtgcagcagctccgggtgtgagccgtcacagtggtagcactcgcgattgttttcgaagaccagtttccagttgcctttctcgacgatgttcgactcgaacgccactttgcagttttcaaggtaatgcggcgcgatgaaagggcttacggctttgcggaatccttcgaagtccggagccttggcggccacgcagacgtaaatgtaggtatcaacgatctcgcagtgaacgcttttcagactgtattgggatttgtcgaaatcctggcccatgttgccggcgaacaacaggttgccatccagctcgtacgtccacttgtgatacgggcaaaccatcttcgccactttgccgtgatcggcttcgcagattttcgcgccacggtgacggcaggcgttatggaacgcccggacctcgccgtctttgccgcgtaccactgcaacgggatagtccccgatctgcagggtgaaatactgccccggtttggtgatttcaaaggtgtggccggcgaaaatccagtccttgtgccagatctgctcaagatcctggcggtaaacgctttcactgctgtaaagagcgccgggcagcgagtgccagggtttgcgttgtgcgatcaggtcaaaaacgctttctttattgttcatttttatcctcccataggcgacatggttctcagcctatatggcccaggacagacgccgcaaacgacatttgctgtgggcaattcatgcgttggcgttatcgatgaggcccttactggagtggcggaatggcgtgaaaaatcgcttccagggcagtaatggcacagggcgactgcgcaatgtgttggatcgccgctttcaccgcagcgctgcgctccacacccaggccgctggcgaacagatcaaatttctgccccagctcttcagcgctgagggccgtttcgggatcgccacgcgcggcggtgaccgcactcaccagcacggcaccgtttttcagggtgatggtcagtcgcgagaggatttcgtcggggaagcgagcggagatatcagcggcttcgacgacttcgatacggcggctcagtgccagaatatcttcggcaaaaatcgccgccccggtgacttcttccggaccgaccttgccccgcacaatcagtgcggccagcgggaaggcgagggcgtactgcgcctggtcggcatcacttggtgtatggccctgcaaacacatcgactcgtagaacgtttccacgcgaacggtttctatcgagtcggcatcgagctgtggattttcccgctgcagttcgagcatggcggtcagcgccggttgcgcccagcggcagactggccagggtttgaagtactggctgtcgatctcccagcgtgtaccgatatcggtccagtattcagcgacggtgacgtcttcaaccgtttctgccggtgcaccggtgatgccttcccgggccatgagcagggcgttcaaacccgcaaatgcacctgcgccgtgggcatcgcgcagcatcgtcggcgcgtgtatcaggcgcatcatcgggcagcgtgcgctgaagtactcggcgatgcccaaagcgtggcgaaacgtcggttcatccaagcccagcaagcgcgcgccagcgcagacaacaccgagcgcggaaaaaccgccggatgcgtgataagtcggcgaggtcgccatcaatgcggaaccggcccgcagcgccgtttcataaccgatgcacagagcggtgagcagttcatggccgctgatcgactggcctcgatgatgcagcgcatcggcgagggcaagcaccgcaggaacaacagtggcaccggcgtggcccttggatttgaagtggccttcgtgggcgtcgaggctgtcagcactgaaacctccggcccaggctgcgccgagtacgttgacgcgctgtccggcaaagatcagacgactgctataagcgcccgccgggtaatgcagttcggcaaaacgccgcatggcgctgctggtgtcattgctggccgcgccggccatgacgccgacgatgtccagcaaactgttctgcacaattgcacgagtcttgaacggggcaccgaggaaatcaaagtcgcgacagaattcgaacagtgacattcaacaatcccttcctgtgagttgagccgagccgatcatggtcggcgcggctcaacaatgagccagggggagggtgctgctctagcaacattttcgtcgggctattgataaccaaatcagccgacgcctgtgcggactgaattaacggcggggaaacttcgccagaatccattcgcgaaaacgccgcagctcgtcttcgttttcggagctttcgcgacagctcaggtagtgccagctgttgcgcaactgcacctgttgctcgatcgggcgcaccagcaagccttgctgcaccaaccccgtgaccaggtgattccagcccagcgcaatgccctgatgggtcaagaccatgctgatgagcaggttgtagtcgttggcgttgaagatctgcgggctgttcggcggacgatcatcgatatcgatggcctgaaacgccagccacacgccccagtcgacatgctcggcaacttgcgagcggccgtagggactgaggttgagcaatgccgaatcacgcacgccttcgatcgtcgaaatttccgggtgcttctccagatactgcggggtgcacaccgggtaaatcacgtcgtggcacaacgggtagcttctataaccgtcacggatgcgcgaaatcttggtgatgaagatgtccggctggacaccgggttccatggtcagaaagttctgcgtggtgatcaggttgagctcgatgtccgggcactgcgcgaagaactcctgcagatgattcgacagccacagcgcggaaaaggccggcgagcaacagacggtcagaaccttcttggtcgactggctgctgcggatgcgttcggcagcctgggcgatgttgacgaacgaaagttgcgcggcatcgaagaacaccgcgccggcggccgtcagctccaccgcacggccgacccgggtaaacagttgcgcgcccaggtagctttccagctcacggatctgccggctgatcgcggcttgggaaacgcacagtgcctccgccgcacgggtgaagctttcgtatttggccgcagccacaaatgccttcacagccctcaaggacggcattttcagcaggatggtgtcagggtcgacatgcttgctcattcgtacactctcctaacgatacagctccccaacgaagcgcgaggagggtaacggaaccgtccgccgtgggctatgccggcgtcgctgcggggatagacccggtcgctcagggcacgaaagcggctgttactcgccaccgtcgtcatctccgataacctgacgttatcaaattgtccctgtaaatgtagttggattaaccggggtgatgctaatagatttgaaacatccctttttcctgggacctcaaaaataataaaaggaagcccgtcgtgaagacatctattcattaccgctgccgcttacaattatttttgctcgtttgcctgtcgcttaatgcgaaagatgcacgatgcgaaggaggcaaggtatgacaagttccgacgagatcatctgcgtaaagaatgttttcaaagtcttcggtacgcagccagcacttgccatgaaaatggttaaagaaggcgcgtcaaaagctgaagtgtttaaaaagaccggtcaggcgattggtgtttttgatgccaacttctctgttcgccgtggcgagattttcgtcatcatgggtttgtccggctctggcaaatcgaccatggtcagattgttcaatcggttgatcgaaccaaccgccggccagatctttctcaatggcaaggaaatcaccggcctgggcgacaaggacttgttgcaggttcgccgcaaagacatgggcatggttttccagtcgtttgctttgatgccgcacatgagtgtcatcgacaacgtcagcttcggcctggaaatcagcggtgtcagcgaaaaagaacgctattgccgcgcgatgggcgcactggagcaggtcgggctttcggggcaggagctgagctttcctcaccaactctccggcggcatgcagcaacgcgtcggtctggcccgcgcgctggccaacgatcccgccattctgctgatggacgaagccttctcggcactcgatccgatgattcgcagcgagatgcagggcgagctgatcaagcttcaggccgagcaggaccgcacgatcattttcatctcccacgatatcgaagaagcggttcgcatcggtcaccgcattgcgatcatggaaggcgggcgcgtggtgcaaatcggtacgccgcgtgaacttctgtgcaagccggtgaataaatatgtgcgtgatttctttaatggcttcgacaccagtcgcattctgaaagcgggcgatatcgcgcaacaggattgcaatgtcgcttatataccgggcgggcaaacaccgattaaagcggaagcgtctctgcgagacatctttcatctggttgctgcctcggcgactcccatgccggttgtggatgaagttgggctttataaaggctctatttcgcaaggccatcttctgagctgcctgtgtaacagctgaactgcgaataaccagaattgatacgccgtttctgagtgcgaggtagcatcatgtcagacttcaactttttagatccctttcaaagtctcaatattcctttgggatcctgggtggaaaccgcccttaaatacttggtgcataacttcagggaagtgtttcgctcgatccgctggccagtcgatcaagtgctcgacggtgtccagtggggattactgtcggttccgcccacggtattcatcatcatcgccggactgatcagttggcagattggcggcaagcgcatcgccattttcagcgttgcaacgctcaccggacttggattgatcggtgtgtggagcgatgcgatggtcacgctcgccctggtgctgacgtcgctgttgttctgcgcagtgatcggcataccgctgggcatcctgtgcgcacgcagtgatcgcacggaaatgatcatccgcccggtgctggatgccatgcagacattgccggcgtttgtctatctggtgccggtggtgatgctttttggtatcggcaacgtccccggtgtgatcgtcaccatcatcttttccgtcgcgccgctggtgcggctgaccaaccttggtattcgccaagtccctgcggacaaggtcgaagccgcccgagcgttcggctgcacggccacgcaaatgctgatgaaggtgcagttgccgttggcggcgccaacgatgatggccggcctcaaccagacactgatgctgtcgctgtcgatggtggtggtcgcctcgatgatttcggtgggcggtctgggcttgatggtgttgagcggcatcggtcgcctcgacatgggcctggccagcgtcggcggtgccggcctggtgctgctcgcggtattccttgaccgactgacccaggcaatgggtgagcgcagcagcgatctggccagcggtcagcgctggtatgaaagcggcccggtggggctattcatgaaactgaagaaaaagaagaacgttgcacgtccagtgacgaattgagttggcctgctcaccccattaaaaattccaagcgtggtgaaacatgaaactgacatatctcaagaaaagcgtggttgcgagcctggtggcttcggtgtttggcaccttgctgtgctcggcggtttacgcggccgatgccaacaaacccggcgcgggcgtttcgattacgccgatcttcccgactatcgccgaagagcgctttcgcggtgaagtcgtgatcgctggcctcaaggaactgggctacgacgtcaaacagccgaaagaagtcgactacccggcgatgtttctcgcgctgtcttacggcgacgcggatttcaccgtgcatgaatgggaacacctgcaccaagcgttttatgagaaggccggcggcgatgacgtgatggtcaaggtcgggcaagtcatgaaaggcgtgctgcagggctacatgatcgacaagaagaccgccgaggcttatcagatcaaggatctgtcagacctgaagaaacccgaaatcgccaaactcttcgacagcaacggtgacggcaaggctgacctgacaggctgcaacccggggtggggctgcgaaatcatggttgagcaccacatgaaagcctacggtctggggcccaccgtggtcgacaaccgcggctcgtacttcgcgttgatggcggacaccattgcgcgctttcagcaaggcaagcccgtgctgttcttcacttgggttccgcagtggatcgccagcgtattggtggaagggcgtgatgtggtctggttgccggtgccgttcacctcgctgccggatggcaaggaaagcaaggacactttccatgatggcaagaacctcggtttcccggtggacacggtcaatgccgtgatgaacaaagagttcgccgagaagaacccggtggcgcgcaaattcctctctgaagtcagcatccctacggccgctgaaagtgcgcaaaacctgcgcatgcaaaacggtgaaaagtcgctggccgacatcaagcggcatgccgcggaatggatcaaggccaatcagcaagcctatgacggctggttgagtgacgcccgagcggcagcgaagtaatcggtgcaactacgggttggcggcgggccgtgccagtcgccaaaccaacgggttgtcgtttcaagtgaaggtgagcgggtgacgcaagatggaaacgttccagagtccgttgaaacaacagaacaccggatttcgccaatccaccgtgatgtcgggccatgaacgtgtggtgcgggtggcgtttatcctgctcgatcatttttcgttgacgacgctttcaacgtcgatggatgccctggccactggaaacctgatcaacggcgagacgatttacgaggtatccacttactccgttcagggcgggctggttgaaagtgatatcggcgtgtcgctggcctcgcaaaggctggtcgcagaaggcttcagtcatgatgcagtgattgtcgtcggtggccagcgtgtgaggcttgccacgcagccagtgctgcgccgagtgctgaagaagtccgcgagcaaagggatcgtcgccggttgctggaatgccgcgttttatctggctgacgccggtttgctagagactggggactttgcttgtcacagcgacagctgcggcctgatccatgaatatttcccgcagttgaacgtttcgactcgcgagtttgtttgcacacagcgtcgagccacttgcgccaacgctcattcggcgctggatatgaccctggcgatcatgcaggaactgggcgcgcgcaacgatgcggcactggtcgatgaaataaaacgggttcaccaacctggacaagctcacccgaagtttgcggcaaacgccgacagccttcgctgctcttcgattccaaagcctttgaatatcgcgctcgacttgatggaaaagaacattgaggaaccgctggaaatcgatgcaatcgccagccaggtcggcgtgtcacgccggcaactggaaagaaggtttgcccgttacctgaatgcggcaccgaatcgctactacctggagctgcgtttgacacgggctcggcaattgattgtgcaaagtgaccgctcgttgacggatgtggcactggccaccgggtttgtcagttatccgcacttctataaacgcttcaaggacctgttcggcttaccgcccatgaccttcagggattattactacgccaacgactatgccagtagcggacgttatgccgtggcggccaatttttagaacaaacagttaatcgtcactgtttgcgcaagtgccagttttgcaagtttccggatcaacgccactgcgtgcgtttgctttgtgccgcgtgcgttttgcaacttcaacgattaacggttcaacactatgaaagtcagttcattacccgccgatgatgatagttgtggctggtttcacttgagcaagccacgcagtcccgagccggctcaccgcgggcaccgttcagcccgctgggtgatcatcggtgccggcttcacgggtctggcgtgcgcgcggcaactggcgttgaattttcccgacgacgaagtgctgctcatcgaagcgcaggaagtcggactgggcccgtcggggcgtaatgccggttttgccattgatcttccccatgatattggcgctgaggattacatcggtgacatcgcgctggcccgaaccagtttgaaactcaatctggccggccaatcgatacttcgcgagctggtcgatcaataccgtatcgaatgccagatgagagcttgcggcaaatatcaggcggcggtagagacccgcggtattgccgtcctcgatgcctatcgccggggcctggaaaaactcgatcagccttttcaaatgattgatgccgatgagttgcccgaacacttgggcacgcgcttttaccgcaaggcattgttcaccccgggggcggtgctactgcaaccgtccgggctggtgaaaggcctcgccgacaacctgccatcgaacgtcacgctgtatgagcgcaccccgattctggaagtggagtacggcgccaagactgtcctcaagcacgctcacggcagcatcaccgccgacaagctgattctggcgaacaactcgttcggtatgcgtttcggtttcctgcaagggcgcatgttgccgatctacacctacgccagcattacgcggccgctgaccgaagaggaacaggcgcgccttggcggtaaaccgttctggggcgccattccggcggatccgttcggcaccacggtgcgccgcaccccggataaccgcctgctgatccgcaacagtttcaccttcaacccggatggtcgcagcaacagcaaatacaacgaacgtttcgtgcgccggcacaaggcgtcattcgatcagcgtttcccgatgttgccggacgtgacgttcgactacacctggggcggcgccttggccatgtcccgcaaccacaacggctttttcggtgaactggcgcccaatgtttatggcgcgctcggatgcaacggtctgggcgtcacgcgcggaaccgtcaccggcaagttgctcgcggactggctggcggggcagcgcgacccactgattgatttcctgttgcaggcgccagggcccaacagcaacccgccagaaccgtttctttcgctgggggtgaacatgaacctcaagtgggggcagtaccgcgccgggagagaaagctgagtctgcgttgactagtcgctgaagcctcgtcgctttgctgccgtcctgaaggcttgcgccgccaataaccacggtctgcccggcatgccgtcgggcgcacggattgaacattgaaccactggagaaaacgctatgaactttgacggaatttttacccctgccattaccccgttgtccgctgatggccagatcgactattcggccttctccgacgtgctcgaatacctgatcgagtccaaggttcacggcatcgttatcggcggctccaccggcgagtattacgcgcacaccgccgaggagcgggtggccgtggccgagcgtgccaaggatgtaattcgtgggcgcttgccgctggtcatcggcactggcggcattcgtaccgaagactcggtgtacttcgccgaaaaagccaagtccctcgaagcggacgccattttggtcggttcaccaccgtatgccttgccgacgcagaaggaaattgccgctcacgtgctcgccgtggacaaggccgccgggctgccgatcatgttgtacaactatccgtcgcggatgggcgtggcgatgggcgacgagtttttccaagcgattgccggctgcaagaacatcgccgccatcaaggaaagttcgggcgagatgagtcgcctgcaccgtctggctcatgcccatccgtcgatccagttgtcttgtggctgggatgatcaggctttggagttcttcgcctggggcgcgcgcagttgggtgtgcgccggctcgaacttcatcccgcgtgaacacattgcgctctacgaagcctgtgtcctggagaagaacttcgataagggccggcggatcatgtcggcgatgctgccattgatggatttcctcgagagcggcaagttcgtgcaatcgatcaaacatggcagcgaactcagtggcctgcgtgccggcggtgtccgggcgccactgcaagcgctggagccttccgagaagcaagcgctggaaagcgtgatcaaaacccttcagaacaacgtcgcgcgtatcgtcgaggaggcttgaaatggcagatctgctgagtcaagagcaataccgtgaactggctgcgaaactcgagtttcgcaatcaagcgttcatcaatgggcagttctgcgccgccagatcgggcaagacattcaccacaaccaacccggctaccgatcaggtgctgactgaaattgccgcgtgcaatgccgacgatgtcgatgcagcggtagcggcggccaaggaggccttcgccgacgcacgctggcattcactggctccgtcggcacgcaaatcggtattgctgcgctttgctcagttgctggaggacaacgcccacgaactggcggtgctcgaaagcctggacagtggcaagccaattcgtgaatgtcagaacatcgacgtaccggaaacgattcatacgttgcgctggcacgctgagctgatcgacaagatctacgacgctacggcgcccgtcggctcgggtgcagtgaccatggtggtgcgcgagccgatcggggttgtcggcctggtgctgccgtggaacttcccgctgctgatgctcgcctggaaaatcggcccgtcgctggcagcaggttgctcgatcgtggtcaaaccggccaaggaaaccaccttgagcacttcgcgcgtcgccgaactggcgcatcaggcggggattcccgccggtgtcttcaacgtcgtgcccgggggagggaaggaggcgggcgagccgttggggcgtcatcctgacgtggccatggtcagcttcaccggctcaaccgacaccgggcggctgtttctcaaatactccagcgaatcgaacctcaaacgtatcgtgctggaatgtggcggcaagaacccggccgtggtgatgaatgatgtcgaagacatcgatgtcgtcgctcagcatgtagtaaacggcgcgttctggaacatgggtgaaaactgctcggcctcatcaaggctgatcgtgcacgccgacatcaaggatgaactgttgctgcgtgtgcaggtgcatctgggcgattggaaaatgggcgacccactcgatcctgagaaccgcttgggttcgatgatcagcaaggcgcatttcgagaaagtccgttcttaccttgacgttgcccgcgacgagaacctcagcgtgttggtgggcggcaagacggccaaagacatcttcgtcgaaccgaccatcgttgatggcgtgaaccgcgatagtcgcctgttccaggaagagatcttcggcccggtgctgagcgtcaccacgttccagaccgtcgacgaagccattgaactggccaacgacacggcctatggcctggcggcatcggcttacaccggcaacctgcgccatgcgctgaaactctcgcgcgggatccgtgccgggattgtcacggtgaactgcttcggtgagggcgacgcctctacgccattcggcggctacaaggaatcggggttcggcgggcgcgacaagtcgatctgggcgcacgaccaatacaccgaaatcaaaaccatctggattgacgcgtcctgacagcaacttcgccgcaagaagccggatcgccccgaccactggattgagtggaggggcgattgccccataccgttaaccaatccatgaactggaattgttggtggccacatcagcagaaagctttcagtcatccgcttttcgtcagacattttgaacctaactcgaaaccgctggctcaaccgggaaatattcggggtgggcgaaatgaacgcgttcaagaaccaactgacattcgcacaagaaaccagtttactcgctttggctgcctggcaacgcgcactggaaaaccttgaattgcgcatggactgcccagacgcctatcacgacgaactggtgcgccagtcggatgaaatggatcgcttgggcctgctcagctgggacgagtggcgcgacctgcgcagagaagcagacgtcgcctacctgcgcgcagtcgctggagacgattaccattgaggtcatgtacggtcgttatccgcatcctctgaaagatcgaatcaagaaaacaggagatttccatgcccgagccgttgacctcatcagctgcacctgctcgctcctggttcgcccgtttctctgggtccggatggggcgggcgcgtcttctggtcgattctgatcggcgtgacagtcttcctgctgattagcggctatggcgccttcgtcggggccaacaaacagaatctgcacttcgcctttatcggtggcatgacaggcttcgctgccacggcaatgggcgctgtcgtagcgattgcgttacgagacatcgccgcccgaacccaagacatcatgctcggcttcgccgccgggatgatgctggcggccagttcgttttcgctgattctgcctggcatagaagcggctcaggcgctttgcggtaacccgttgctcgcagcttgcgtcgtcgttgcaggattgggactgggcgtcgcgctgatggtcgggcttgatcgtttcgtgcctcacgaacacgagaaaagcggacgccgggggccagatgcgcagcgcatcaatcgtgtctggttgttcgtcctggcaatcacactgcataacctgccggaaggcatggccattggcgtgagcttcgccaacggcgatatgaaggtgggactgccgctgacgactgccatcgccattcaagacattcctgaaggtctggcagtcgccctggcattacgcgtaaccggcatctccgcactgcgcgcagcgctgattgcggtgggttcggggttgatggaacccattggcgccatcgtcggcttgggtatttccagcagctttgcgttgggatatcccattgcgctcggtctggcagccggggcgatgatttttgtggtgtcccatgaggtcattcccgagacccatcgcaacgggcatgagaccccggccacgttgggactgatgctcggctttggggtgatgatgtttctcgacactgctttgggttaatcacgaacctgaccaatggagagaaaccgtcacgcactggctttaacctcacccctgaccactgatttacgataggtcagcaaaacgatgcccgtgaccacgatcaccccaccgagaatctgtccgttgctgagcatctggtccagcacaatccagcccatcagcagcgttgccaatggctcgatgttcatgaccggcgcattgcgcggcatgtcgagtcgaggcacggaaatgaacaggacgataaaaccggtgccgtacagcaccaccaaggtggcgagggccagccatccggtcgaggtggcgggcaggttcaatccgccgggaagggcgcccgtcagccctgccaggttgacgctgctgaacacgatgaaaatggtcagcagactgcgcaccgagccgcgtacctgagacagtttgtggtcggtgatccacagcgcgcaggcgaacacgctggcggcgcagaacgcgagcgcgacgcccgtcagccattgtgcactgacctctgtcgtggtcgaaagacgcccgggcacgtccagtacaaacaccaggcccagtagaatcaagcccattaacgtcgcagtgcgtgcgctcggtcgctggccacccagcgcccaggtgagcaatgccagcagaatagggaatacgtttgccaccagcagggccagcgccaccggcacccgtgcgacagcagagtaaaggcacagactctgcgcagtgatcagcaaccccagcaacagttgccagcgccaggcacccgccggcaagcgcgggctttgtcgttgccacagcaccagaatcgcgagcaccagcaaggtcccgccggaccgcatcaaaatcgccagcagcacacccgcaccatcatcaaatgcgactcgcgccgccacatgattgccggcaaacgcacagcccatgcacaacagaatgatcaccgccagataacgggggtagggcggcggtacggtttgcgtagcggtagggcgaggcatggcagatctcaggattgttagccgttcgaacgacttggtttttattaggttgtcgtacaaccagcccgttttatcgcattcggcgacgtcgggcaatagacctgaaagcgcacagctacgcatatgttcggctttatgctggatttttcgcgcctttgattgagtgtggagatcgtatgacttgatagagctggggcccatcggcccctgcttccagggatttacacattcatgagaggcgggtcgtctgcttctgctcaggcatgaaatggataatcgatgtagccacgctgatccccgccgaaaaagctgccagggtccggcgtgttgagtgtcaggccatcgtgcagtcgacgcggcaaatcagggttggccaggaatgggcggccaaacgcgatgatgtcggcacgatcggcaatcagcgcctgttcggcagattgcgcatcgtagccgcccgccaggatcagcacgccgttccaggttttgcgcaactgggcaatgatcgcgtcccagcgcgggtcgaaattttcatctttgactgtgccgaccatcgctggctcgaccaggtgtagataggccaggttccattggttgagcgcctcgaccaagtggccgaaggtggcttccggggtgtcatcgcccatgcccatgaaacggcccatcggcgtcaggcgtacgccgacccgctcggcgccaacttcttcagccacggccgcgaccacttccagcagaaaccgcgcgcgattctccacgctgccgccataggcatcgtcacgctggttgctgttgctgttaagaaactgatcgagcaggtaaccgttaccggcatgaatctctacaccgtccatgcccgcctgcagcgcgttgcgcgcggccaagcggtagtcttcgacgataccggcgatttccgcggtttccagcgcgcgtggcaccggcacatcaccccagacgccgttaccgttgtcgtcgacgataaacgtcttgcccggcaccggcagcgcgctgggtgcaaccggcaggccggcatcaggttggaaactggggtgggacacccggccaacgtgccacagctgcatgaagatcaacccgccagcctcatgcaccgccgcgctgacgtcacgccacgcccgcacctgctcagggctgtagatgcccggcgtccaggcgtaaccctgagcctgccgggagatttgcgtggcctcggtgatgatcagcgcagcactggcccgttggcggtagtactcggcgttcatcggcgttggcacatcgcctggttggccggcgcgtgagcgcgttaacggcgccatggccacgcgatgggcgagggtgtaaggaccgagtgcgaggggttggaacagacgacgggtcatgggtagctccagatttcaataaggggaattcaagcgcggcagcggcgccgcgaaccagtgccgctaacttaaccgcgctcagcggggctgataatcggtggccggcgctacgctgttttgcgcagggcgcaacggcacccgtgctcatcagcgatgaacacgggcgtggctcaggcgggctggtttgagcgtgtgagtggcaggttcagccagcgccggccggtggcgttggcgacggcgttaccaagggcggcggccatcggcccctggacaatttcagcggcaccgaggaacggttctcccggttggtcgagcaaatgcacatcgacttttttcggcagttgcgtgaagcgcagaatcggataaccgctccagtcgtagctgcgaatgccccccgcgtcgtaggcgactttttcgtacagggtccaactcgcggactgcatgatgccgccctcgacctgattgcgcaggccgtcggggctgacgatctggccgacatccaccgccgtcaccacgtgatcgatgcgaatctcgccggtctgcggatgcacccgaagtttcaccgcgatggcacagtaacccatgatgtttttgtagcgggcgaaggcgaaaccgatcccggcgccgggctcgctgcttttttgcggccagccgatctcatcacgcacacgttctaccaccgcgcgagcacgcgggtcgctgagatgggccagacgcaaggcgaccgcgtcgatgccggccctgatcgccaactcgtcgatgctcgcctcgatggcgaagatattgatgtgcgcccccagcgaacgcatggccgaggtgcgaaagggcatctgggtgacgaaggtcatattgatgcgcttcgagttcaactcgtacagcggcaccgcgttgcgatcaccatcgccttcgggctgggcgatcggcacggagggcgctgaggtgaagggccgcgcaagcaagcgtgccggcagcagacgcccggcgttgacgatgcgttcgttgtgcggtgtggtccagagttcgtaggcccagtcctgcagccgaccctggctgaggcccgcgtcgacttcggtgaccatcgccgagctatacggctcccaaagattttcctgttcgcgcatccattgcacgcgcaccggcgtaccgggcacacgcagagcaatcaatgcagcatcggccgcggcatcatcggcaccgttatgcccatagcaacctgagccttcggtatgaatacagcgcacccgctcaggtggcagaccgagcatttcggcaatgccggcgcgcagcggataaacaccttgggtgtgggtccagaccgtgagattgccgtccttgaaccaggccaccgcgcaagacgggccgatcgagccgtgcatcaaatactgcttggtgacccgcgcctgaaaacgcgtgtcggccgcgccgctcggcgtgccgctgttgctgatcggatagcgccgtgagggcaggcgtttgagcagaccatgaatctcggccgcctctggaatcgcttcgccctcgctccattgcgtcacctcgctggccctgcgcatggctttgatcgcttgccactcatcaccggcggccaccgccagatagttgccgtcgcggatcaccttgaccacgccagccaacgcctcgatggactccgcatcgaatgcttgtagcgtgcagcccggacgcggcgggcggatcacccgcgcatgcagcatgcccggcaggcgcatgtcctggacgaacgccgcgccgccgctgaccttcgccgggatgtcgaggcgcggcaacgaatggccgatcagtttgaagtcagcggcggccatcgccggtgattgagccttggcgtattggtgcacatcgacatgcttgaccgcgtcggcgtaactcatccgctgagcggccgggccttcgatcacaccgttgtgagtgctgagcagtgcagcatcaacctgccaacttcgcgcggcggcctcgacgagcatttcgcgaacttgtgcggcggcgttatacaacgctgtaccgctgtcgaaaatgctgtggctgccggcggtgtagccttcgttgggcgtcagcgcggtgtcggcggtgagcaggttgatggaggtggccggcacctgcaaacgttcggcagcaatttgcagcagtgcggttttcaccccggtgcccaattcgaccttgccggtgtagacggtgatgccgtcagcgccgatgcggatccaggcgtcgagaaacgggttggtgcgcaggctgccgggcaggtcaggcgcgaggaccacggtgccaagcgtatcgacttccgtatccgccaacacacgccgcgccaccggcatcaaggtaaacgccatcagcaacgcgccgccgcgcaggaaggcgcgtcggctcgggttcaaaccgttcgactcgctcatgtcaggctcccgttgtgcccggccacctgtttgatcgcctcgatgatccgcaagtgcgtaccgcagcggcacaggttgccggccatgtgctcgcgaatggtcgcctcatccgggtgtcgattacgctcaagcaacgcttgcgcgcgcatcagcatgccggcaatgcagtagccgcattgcgcagcctgtttctcgatgaatgcggcttgcagagggccaggtttttctgcgctgccgaggctctccacggtgcggatttttttgccttcgaggccggcgcagggtgtcaggcaggcgaacaccggttgatcgtcgacgatcaccgtgcaggcgccgcactgaccgagaccgcagccgtatttggcgccgttgaggttcaagtgattgcgcagcgcatacagcagtggcatgtccggctccagctcaagcggttgcgcggctccgttgacgttgagggtgatctggctcatttcgtctcctgacgtaacgcttcaatagtggaagagaggtcggcccacggctgatcagggctggcttgctgacgcagatacgcggccagtgcaccgagttgcgcgttgtccaggctggcggcgaacgcaggcatcaccgggccgggcgacccggctgtggcgggcaacccttcgagcacggttttgagaaagttgcgcgaactggccgcttgcaacgccgaggtgttttgcaggcccgggcgaccatcgatggtgcgcattggcgccgccgcaccatggcaaccggcgcaggcgctgctgaagagcagggcgccggtcgagtggtctgccggttcattggcaggcgtcttcggtggcgtctctgtcaccgaaggcgggttttccagactgagcacatattcggcaatcgcctcggcttcactggcgggcaggcgcgccagactcaagctgaccggacgcatcggcccggcgggtgtgccgtggccatcaacgatttcggcgcgcagatagctcaccagttgctcacgacgccacgggttgccgcgttggcccataccgaccaacgcgggcgcttgccagccatcgacgctgccgccctgcagatactccgaggatttttccgcgccgatcaggttcagcggcgaatggcagccggcgcaatggcccgggccgtcgaccagataacgcccgcgattccacgcctcgctacgccccgccagcggcgtcagtggctcaccgtgcaggaacagcaggttccagaacgccaccaacgggcgaatgttcatcggaaagttcatctggttctgctcggccggcgcgtgcacggcggggccgctcatcaagtaggcgtaggcgtcggcgatgtctgctgcgctcatgcgccggtagtgcacgtaggggaacgccggatagagcaagtgaccatcgcgggcaatgccttgacgcatcgcccgctcgaaggctggcagtgaccattggccaataccggtttctacgtccggggtgatgttggtgctgtacagcgtgccgaacggcgttaccagcggcagcccgccggccagatattcaccaccggggcgggtatggcacaccgcacaatcgccggcttcgaccacccgcgctccgcgttgcaactgcgcagtatcgaacatcgtcgggcgctcgatcggcgcaatcgccgggcgccacatcagccaaatggcgccgatcaggccgagcacggcgacgacggccacgctgatccatagcgttctggacttcagaaatgagctgttcatgggacggagaaaaacgcggcaggcaatggcagaacggatgggatacgggtcatgacaacgctccttgtaacagccggggaagggcgccgatggggacgacggcgccaagggccaaagcgtagagaaaccgtctgcgcgggagaatcagcggcgcacgcaatagcgcgttgcgcgagaagcaacgcctgcgccgttgcgccggacgcatcagtgcgttgcccgccgcgtggattctgcacgtcgacacagggccgtagccttggcagcactttcctgaactcaatgaggtgtcatcatgctcacgggcaatccggccgttgcggcgaatgccgaacagccaacttcactttccggcctgatggtcgcgttcctggcattctgctgtggcgcggtcgtggccaatctttattacgcacagccaatcgtcgaactgattgcgccgcagatcggcctgtccagcgccaatgccagcctgatcgtttcgctgacgcagtttggttacgcgctgggcctgttgctgctggtaccgctggccgatttgatggaaaaccgccggctggtggtcgggttcaccctggcggcgagcgtcacgctgttgtgcgccggcctgactcattcgccgtcgatgttcctgctgttgtctttgctcatcggtttgacgtcggtggcggtgcagatcctcgtgccgctggcggcacacctggcgcccgaggccagccgtggccgcgttgtcggcaatatcatgagcggtctgctgctgggcattctgttgtcgcggccactgtcgagcctgttggttgaagtgttcggctggcgcggagtgttttacagcgcatcagccctgatggccgtcatcgctctgattaccgccgtggcattgccgcgtcggctgccgacgcataaagccacgtatgccgcgctgatcggttcggtgtttgccttggcccggcgctatccgctgttgcgtcagcgctcgctgtatcaagggctgctgtttgccagcttcagtctgttctggacgcttgcgccgatagaactgatgcgacaccacggctttactcaggcacaggtggcgatctttgcgctggtcggtgccgtgggtgccattgcggcgccgattgccgggcgtctggccgatgccgggcatggtcgtcgcggcacgctggtcgcactgttgctagcgccggtttcgctgctgatcgccgctcttccgggcagcggctatgtctggctggtggtgtgcgcggtgctgctggatttcgccgtgcaattgagcatggtgctcggccagcgtgaggtctacgccctcgatccccacagccgtgcgcgtctaaacgcggtgtacatgaccagcattttcgtcggcggcgcgctggggtcgctggtcgccagtccgctgtacgagcacttcggctggaacctgtccgccgtcgcggtggcgctgctgccagcgctcgcgctcgggttgtttctgagccgcaaggccgatgtctgaacagccagcgagtgcgtccaagcacggcggtacaagacgtcgggggaacagtgatgcacaatcatccgcgttccctatcgaccggaccccgcttatggacaagttgctggcactgaagatgtttgtggaaaccgtgcgctgcgggggctattcctcggcagcgcgcaaactcgggatatcaacgtcgtcagtgacacggcaagtggcagggctggaacacgagctgggcgcgagcctgctcaatcgcaccacgcgcaacaccagcgtgaccgttgccggccagacctatttcgaaaaagccgtggcgattctcgacgcgatcgacgaagccgatgcggtcgtcgccgatcgtggcgccgaagcgcagggccgtctgcgcatcagcgtgccggtggagttcgggcggcgtctgattgcaccgcacctgagccgtttgcttgaacggcatccggggctggagatcagtctgtcgctgagcgatcaggtcagcgacctgctcagcgagcagatcgatgtttcggtgcggctcggatcgtcggtggtcagtgaagacatcgtcagcaaacgcgtggggcagtttgaacgctgggtggtggccagtccggcgtatctggcacgtagcgcggcgctctgtcatccacgggatttgctggagcaccaatgcctgcgtttcgattacggcggcacccaccaacactggacctttcagaatgaagacgcgcccattcagctcaacgtccatgggcgcctgcaaagcaacaacgccgacatcctgcgcgaagccgccatcggcggcggcggggtgacactgctggctgactggctggtgcgcgacgacgtggcagccggccggttgacccgattgcttgagcagtacgaggtcaatcccggcagtgccagcacctgcatcaacgccttgtatttacccaatcaccgtgggtccagccggatcaatgtgtttatcgatttcctgatggaaattctcagtccggctgccgtgaccacgcccgccgcgtgatccctgcggctcaacggcgcccggtccgcgtactcacatccacccaaaccgccaacaccagaatgctgcccttgacgatcatctgccagtagctgtcgacgtcgagcatcgacatgccgttgtccagactggtaatgaccagcgcgccgaggagggcgccgtacaccgtgccggagcctccgcgcatcgaggtgccgccaatgaagcaggcggcgatggcgtcgagttcccccatgctcccggccgaaggcgaaccggcggcgaggcgcgcggtgttgaccacgccggcgagggcgcacatcacgcccatgatcccgaagatccacagcttcaccgcctgcacattgatcccggacaggcgcgtcgcttccatattgctgcccaccgcatagacgcgccgaccgaacacggtctgactggtcacgtagctgaacactcccaacaaaatcagtagcagcaggacgggcacgggaatgccgtcatagctgttcagcgtctgcacgaaaccggcaagcacggcaccgatcaccaacacgcggatgacatcgcgcaccaatgaatgcgccgcgagaccgtgaagagcgcgattacgccgttgtttccaggtcaagaacacggtcagtgcgaacaacaaaatacccagaccggtgccgatcgcgtggggcaggtaaccctggccaatgtaaaccagctccggcgataccggcgcgatggtcgtgccgccggtaatccccagcagaatcccgcgaaaagccagcatgccgcccaggccgacaatgaacgaggggatgcgcaggtaagccgtcatgtagccgttggcgaagccgatcatcagcccgcacagggcgaccagactgaggttggccaacagcgggatgtgatagaccacatcgagaatggccgcgaggccgccgagcaggccaagcaatgaaccgaccgacaaatcgatctcgccgctgatgatcaccagcaccatgccgcaggcaagaatgccggtaatcgacatctgccgcagcagattggacaggttgcgcggggtgaggaatccgccttcggtctgccagctgaagaacagccagatcaacaccacggcaaacaccagcgcgagcattttgtagcgggtgaacagttgtttgacctgattcatttacgcggatttccgatcattattgttatggctgccaggctggctgagggcggcggcgagcacctgctcttgcgtcagttcatggttgatgaagtcgccacgcaactgaccttcgccaatcaccagcacgcggtcggaaacacccagcacttcggccagctccgacgagaccatgatgatcgacacgccggcagcggccagtgcgcccatcaacttgtagatttcgtatttggcgccgacatcgacgcctcgggtcggctcatcgagaatcagcacccggggtttggccagcagcatcttcgccagcacggctttttgttgattgccacccgacagactggtgatcggcaggaacgaactcgccgtcttgaggtgcaggcgcgagatttcccgatcgatgctgcccagttcggcttcggcatcgatgcgggtcagcttcgagtagttgtccagcacggcgagggtgatgttctggccgacgcccaggtcgggaatgatgccttggcgcttgcggtcctccggcaccaggcacaggccggcgcggatagacttgagcggcgtgcgcgtgtcgatggcttgcccgtcgagccagacttcgccctcatagcggccggggtaagcgccgaacagtgcggtcaccagttcggtgcggccggcaccgaccagcccggcaatgccgaggatttccccgcgcttgagcacgaaggaaatatcgtcgactcgtttgcgcttggggttgtcgacgtcgtagcaggtgatgtggcgggcctcgaaaatcacttcgccaatgtcgtgtggttcgctggggtagaggttgctcatttcccgcccgaccatctgcgtgatgatctgcgcaatgtccatgtcggccatggcggtggtggcgatgtgtttgccgtcgcggatcaccgaaatggtgtcgcacacggcggccacttcatcgagcttgtgcgagatgtagacgcaggcaacgcccttggctttgaggtcgcggatgatgtccagcaatacctcgatttccgaacggctcaaggccgaggagggctcgtcgaggatcagcaggcgtgcttttttattgagggctttggcgatttcgaccagttgctgatagccgccgccgtactgcgacaccggcagcgatacgttcatgtccgggactttcagttcgcgcatcagcgcttcggcgcggtggatcatcgccgggtagttcatgcgcccgccgggcagcgtcagttcgtggcccatgaaaatgttttcggccaccgacaggtcgggtaccagcgtcagttcctgatgaatgatgacgataccggcggcttccgtttcgctgatcgattgcgccttgagcggctgaccgtcccagaagatttcgccgtcccaggtgccgtgcgggtagaccgccgagaggatcttcatcagcgtcgacttgccggcgccattctcgccgcacagaccaacgcattcacccggcctgaccttgatgtcgatgccgttgagtgctttgacaccgccgaaggttttgacgatgccgttcatttgcagcagatagtcggacatgggcagggctcgtatatcaaaggctcacacaccactgaacctgggtgggagcgagcctgctcgcgaaagcgtcagttcagacaatgcttcgttgactgaccatcgcattcgcgagcaagctcgctcccacaagggttttcgcattaccggagatttgtgatgggtcacttaccggcaatttgcgccttggtgtagaagccgtcctgttcgagcaggtcgatgttgtccttggtcagcggggttggcgtgagcaggatggtgtcgacttttttgctgccgttgtcgtactgcgaactgaaggcaggtttttcgttgcgcgccagttgcaccgagagcttggcggcttcggtggcgatgagtttcagcggtttgtatacggtcatggtttgcgtgccggcgatcacgcgcttgactgcagcaaggtcagcgtcctgcccggaaatcggcaccttgccggccaactgctgcgccgccagtgcctggatcgcgccaccggccgtggcgtcgttggaggcaacgatgccgtcgattttgttgtcgttgcgggtcaaggcgttttcaacaatgctcagcgcttcggtcgggttccattccttgacccactgttggccgacgatcttgatatcgcccttgtcgatggccggttgcagcactttcatctggccttcacgcaggatcttggcgttgttgtcggtgggcgctccaccgagcaggaagtagttgcccttgggcgcggcattcagcacgccgctggcctgcatctcgccgactttttcgttatcgaaggaaatgtaggcgtcgacatcagcgttgaggatcagacgatcataggacacaaccttgatcccggctttcttcgcttcggccaccgcattggtcagcaccgtggcgttgaacggcacgatgacgatgacatcgacaccccgggaaatgaggttttcgatctgggaaatctgcttctgctcgttggcatcggctgattgcacgaagaccttggcgtccattttttctgccgccgcgacgaagtaatcacggtcacgcgaccagcgttccaggcgcaggtcatcaatggagaaaccgattttcgggtgagcagcgtcagccattaccggcagtgacaacagcgccagggcagtggccaatagcgtgcgttttacgttcttcatagtggggcgtccttttattgttgttggaaagacacggcctgacgatgagtatcgggctggtaaaactgtagagaatccgcagacgccgcaggcacagaattgtcgtagaaatgtcaccgcgtggatgcgcccgcagactccctgtgtgatcagcgatagataaaccggttgacgatgttctcgagcatttcctggcggccgctgacggcttgcgggttcatctcgttggtgaacgcgtgctcggccaacgactcaaggttgaagtcaccggccatcaccgcttgcccgaacggctgctgccaaccggcgtagcgttgatccttgagcctttgcagttcgtcgttctgcaccatggctgctgcgcgttccaaagacagggcgagcacgtccatggcgccgacgtggccatggaacagatcgatctgatcgaggctttgccggcgcaccttggagtcgaagttgaatccgccgttcttgaatccgccggccttgaggatttcgtaggtggccagggtcatttcttcgacgctgttggggaattgatcggtgtcccagccgttttgcggatcacctcggttggcgtcgatactgccgaaaatccccagcgagacggccgtcgcgatctcgtgatggaagctatgcccggcgagggtggcgtggttggcctcgatgttgaccttgatttcgtgctccagcccgaactgctggagaaagccgaacacggtggcgctgtcgtaatcgtattggtgtttggtcggctcctgcggtttgggttcgatcagcaagtcgccggtgaaaccgatcttgtgcttgtgttcgaccaccatgcgcataaagcggccgagttgttcgcgttcccgtttcaagtcggtgttgagcagggtttcatagccttcgcgaccgccccacaacacatagttggcgcctttcaggcgatgggttgcgttcatggcgctgaacacctgcgcggcggcgcaggcgaacacttccgggtccgggttgctcgcggcgccggcagcgaaacgcgggttgcagaagcaattggcggtgccccacagcagcttgatgccgctggcttcctgatgttgctccaggtgatcaaccatctgtgcgaagtggttgcggtactccttcagcgaactgccttccggggcgacatcggtgtcatggaagcagtaatagtcgatacccaatttggagaagaattcgaaggcggctgccgctttgccgatcgccagttccatcgggtcgccggcatgttgccatgggcgcttgaacgtccccgcgccgaacacatcggaacccggccagacgaacgtgtgccagtaacaggcggccatgcgcaggtgttcgcgcatgggtttgccgaggatgagtttgtcggcgtcgtagtgacgaaaggagaggggagaatcgctgtccgggccttcgtagcgaatcgcatcgacatcggggaaatactgcatggaccttgtccttgttgttcttggcggtgtctcgatactagcaacggccctgtgcccgctgattatgaaaaacatcaacaccgagtgcgattttgcgtattgagcttcttcggccacgcgcctagtctgtgccaatcgcctccgtgaccagaggcccggaacaagcataaaaacaatgaaaaccgtaccgcctgttcaccgcatcgccctgttgttcaacggcagcaagatctacgaccgtggcatcatcagcggcatcggcaactacctgagcagcacccgtgcttcctgggatctgttcctggaggaggattttctctgtcgtctgaaaggcatcgagcgctggcagggtgacgggatcattgccgacttcgacgacccgctgattggcgaggcactggccgatatccagatgccggtggtcgcggtagggggctcgtacgaggataaacgcgcctacccgaaagcgattccctacgtcgccaccgataacaacgcgctgatgaccctcgcttacacgcacttgatcgagactggactgcaacgtttcgcctgcttcagcctgccggaagcgcaagccaatcgttgggctcaggagcgcgaaaaagcctttcgcaaactgatgaaacgcgacggcctgcacggcgaaatctatcgcggcatgggcaccagcgcaccgctgtgggacagcgccgtcgaacaactgatcgcctggctgcaaagcctgcccaaacccatcggcatcatcgccgtcagcgacgcccgcgcgcgccaattgctgcaagcctgcctgaccgccggcattgccgtgccggagcaggtggcattgatcggcatcgacaatgatccgttgacccgcagcctgacccgcgtgccgctgagttcggtcatccagggcacagaaaccatgggccgtaccgctgcgcaattgctgcatcagatgttgcacggcatgccgtcgaccggcacgcagatcctgatcccgccggatgctgtgaacgtgcaggtgtcgagtttgcaccagccattgggcaatccctacgtcatgcaagcgctgctgttcatccgacaatatgcttgccagggcattaaaacggcgcaggtggcggcgtatgtcggtgtgtcgcgttcgtcacttgaagcgcattttcgtgctgagcgagggtgtagcgtgcatgacgagattttgcgtttcaaattggctgcggctaccaggggcctgataagtagcgattcggtgattgccgatgttgcgcgtaattgtgggtttaagtcagcgcagtatttgcacacggtgtttcgccgggagtttggctgtacgccgcgggagtatcagcaagctccgactaaatctcattgctaaaaaagcaatagtcatttgcgattacggcggattgttgccgtcaatatcacaagttagcatcaatccattgctgcaactcatcaggcctttggcgcgagttcgagacagtccacatcgttagcctgtcactgcgctgatcgtcgtctcagttgatcaaccttggaaaattctgatgtcgaagctcttcgaagcacttcgcctgggcgacaccacgctcaaaaaccgcatcgtcatggcgccgctgacccgatcgcgtgcacccaatgatgctgccgatgaacgcgtggcgctgtattacgcgcaacgggctaccgcaggcttgatcgtcagcgaaggcacgccgatttcccgtgaggggcagggctatctgttcaatcccgggatcttcactgccgagcagattgctggatggcgtctgaccaccgactccgtgcatgccgtgggcggcaagatgtttgcgcagatctggcacgtcggccgcgtctcgcatccgtcgatccaggagggtgggaaactgccggtgagcgccacgtcgaagcaagctgtcggcgcgacagcattcggttacgacgctgacggcaagccggcactggtcgagccgccggcaccccgtcaactggaaacggctgaggtgtcgcgcatcgtcggtgaattcgcccaggctgcgcaaaacgcgatcgaggcgggttttgatggcgtggaaattcacggtgccaatggctatctgttcgagcagttcatgaatccgctggtcaatgatcgaaccgatcagtactcggccgatcgactggaaaatcgtctgcgcttcaccctggaagtgatcgatgctgtagtcgcacggattggcgcgggccgggtgggtattcgtatttcgccgtatggtcagctgttcgatatgccgctgtatgagcaaatcgatgaaacctacaccgcgctggccgaggagattggtgcgcgccaactggcctacgttcatgtaatggatcagtccgggtttcctgctccgggcactgagggcggtggcggcgggccgaaggcaactttccttgagttgctgtcgaccatcaagtcgaaattgccggccacagcgctgattctggcgggcggcatgtcgcgccagcgtgcggacgatctgatcaatgacggcatcatcgacctcgccgcatttggcaccgcttacatcagcaaccctgatctggtggcgcggctgcagcacaactggcctctgaccgacgccaagcgcgaaaccttctacggcggcggggcggagggttatgtcgattacccgccctataaaggctaagtagccgctgaagtactggcagccgtcaccgatattcgggacggctgctttttcgtttcggatgcaaacaggcctgcaaggatgtagcgagaggacaagcaggcgaagttctgttttagtgcaaaccaactgttcttgatgatcggattccttatgcacctcaaagcgcaccggtacttcgccatggtcgccgtgactggcagtttctcggcgacggctcggcacttccaagtgccggcgtcgtccgtttcgcgcttcatcgcggcgcttgagcgagaggtgggccagcagcttctgtatcgaaacacccgcgcagtgaaactgacagatgcaggcgagcgctattacctgcagatccgcgaagtgctggaattgctcgatgccgccgatgaggaaatagccggcaagggtggcgaggttcgtggacttgtacggatcaacgcgccagtcgcgttcggcagcctgcacatcgtcaaactgttgaacggtctgtatgacaagtatcccgagctgacggtcgagttgacggtcaccgacgcctttatcgacccggttcaggagggcgccgacctcatctttcgggtcgggcacctgggcgactctggcttgatcggccggaaaatctgcgatcaacactatgttctgtgcgccagtgcgggatacatagcaaagcatggccaacccgtgtcgccggcggatctgcagaatcacgcctgcctggtctacaagggaaccggcggggcgcagcgctggtatttcagaaagcctggcagcgacaaacccgagattatcgacgtccatggtccgctcagaagtaacaatgggcaggtgttggtggaggccgcgctggcgggtagggggatcgtgttttttccgtcctggctttttagtcgcgagagctttatgagccagcagctcattcggctgttacctgattggcagggatcggtggagcaaacgcctagccagatccatctgctttcccctgagaatcgcctgcggtctcagaaggtccgtgtggtgtgggactacttcatcaaagcgatcggcgcgcctccttattgggatgatctcagtgattgttgaggtagaaacaggcagggaatgagctatcttgtcgaactgccgattcgatcaacattccagggacgccaatgctcagttcactcatatcaaatggccaggcacaaacgcctgatcaattagaactgagggtcccttggtggagtttcacgaaaacagtcctggctgcgacagccctgtcgttggtccgagacgggctgatcggactggacgaccagattcctgatgaccctttcacattacgtcagctcttgcggcatgaagcaggactggccgattacggcgaacttgcggagtatcacgcagccgttaccaacggtgaatctgcctggtcggcggacgaaatgatgcagcgccttgacggcacttcacttcgatacagtcccggatccagttggcgttactcaaatgttggctacttgctcgttggcagactgattgaacggctaactgaactgacgcttgatgaggcggtgcttcaacgggcgatttcacctctgggcctgtcgaacgttcgctttgctaaaacgcgagcagacttacaagcgacccatcccgaatgcaccttgaattatgaccctgcgtgggtttatcacggcctgttggtcggcccggtttcgcaagcagcgctatttctcgatcgcctcctcagcgccgacttgctaaccacagacttgctccagcaaatgcaggcagcgcgaacattgggcggcccgatccccggacgcccatggatcactccgggctatggacttggtgtgatgcagggggcgattggcagcgggcattccctctgcgggcacactggttgcggaccaggtagtgtcatcgcggtctaccgtatcggcgacgccgacgcatcagcttgttgtgcagtttttgaggcaggcgtaaatgaaggcgctgtcgaggcccgcgttgttggacgactgatgcaagtactgcagcacagggatgaaaacatctgaaaacggcagtaggccgacaacggcggctttgggaacaggttaccgagacaccgggtttgtgcaaaatcgaccgggttagtgtaagtggacatgctgcaaggtcgcatagcgtaatacacgatttaacataatatacattacacgtaacaagatgttgcgagatcagcccggttgcacagtggatttcaacctgcagaatcgccctgaatccgatccacagcttttccttgagttcgacgcctatcaaccctcatcacgcgtcagcttttcaatcaacgttcgatgctgtggaaattgctgcgtgagtttctgccgatcacccatttccatatcggcaaaatcaaatcctggcgaaacggcttcgctgatcagcccaaatccattttcgccttcgagcaaccgtgaggctttccatattccacccggtacgtgtaattgcaaaagctgtcctgccagaaagtcggcgcccatcaccaatgtctgtaacgagccgtcagcatgaatcaggctgtactcaatggcgtcgcccaggtggaaataatgcaggatgtcggatcgattgaaatgaaactggcccaccggtgattgctgatccagcagatagtaaatcgaagtcgtcagataccgtgggccgctgggggtttcgagtgggtcgcgatgatcggcctgataggttctgcggaagtagccaccttcgaggtgaggctgcagatccaacgttttaataatgtctccagctttcgcttcacgcttgatcatgggctcttctccgtcgaatatgctgctaatttacgttaactcgactaaacggccatttagtgtagttaaacgtgagccgctagctttctagtaaatatagggccacgctcgcaccgctgcttttgaaattcgctacgccggtggtatcgccaagcaatcatgacggagtcgccctaccctcaacgcaaaacctccccccccgatcggcttcttcgtgggcaccttttttcaattactgccggaccaaggcaactcggtgactatcgcgccggtactccctcgatcaagtagacatccgtcttggctgaacgctggcggactttcctcagctccgtgtattgcgcagagttgtaccaagcctgggctttttcgacgctggcgaactcgatgacaacacggcgtcgctttggcgtttcaccttcaagcgagatggtctttccgccacgcacgatgaaatgtccgccatagggtttgaaggttgattcgacctgtgcactgtaaggcttcatcccctcggaatcggttacttcaaactcggcgacatagtaggccggcgcggccgccgcttgggcgtcggatgcctgacaactgcccgccgcaaaatacgccagtcccgccatcgcaattgccgtcacctgcaaatttttcatcacattcctccatttaaaaaatcagcttgcccagcgcgcaaatctctttcgaactagccggttacgggccaggccgggggctaagctcgattggcgtggtttcaatcaagcgcttcgacacaatcatcgactgggttgttgcagcgtactttttgaagtgcggcgattcgatatggcttcggtatgccgaatcgcttgcgtagatttcgaagaaatgaaaccagttcgggcggtcgacttcggcgacggcgtagattgatatgacgcccagctctgttcgagtcgactctgtgatctcttctttgactgcggcttgataggccgcaacctgtgcaggatcgatttcgagttgcgcgatgcgcaccaccaagccattttccccggcggccagggcttgtcctgccagtaatccagccaatgccaccactcctagtacccggagcgatacgcgccaatgcacggctgactgaaggcagcagcacatcggcgacataatcggaggctacgacggtgatgtgccgattgcagtgtgccgggtcaaaattcagcggcgcgtcgacgacttcccgtgtcagcgccaacgcagcacgcacttttggcagcaactccaggcccagcgccgtgggttcgaggcggcgtcccacttgtaccagtaacgggtcgttgaaatgttcacgcaagcggcccagtgccgagctggcagctgactgccccaggcacagacgctcggccgcccggctgacgctgcattcgctcagcaaagcatccagcgcaaccaatagattaaggtcgaggcgtcgatatcgcatgtcggttccgctgatgggcgtgggtcaggtgtttgcccggaatggcgggcatggtccacacctcaatcatgaccttaaccagcggcttaccgatgtaccaatcgcctgtatcgctggcaggtatcgtcaacaacgataccaggcaccagcgaggcgtgactcaggttgggaactccctgcacccttggctcagcggcgcagcagtcgattgaccaagagcaggacggccgcgccaatggcgagtgcggcgacgggtttctctttaacgaacgtcgagacgctgtcgagggtatcgccgtaggttttggtcagttggccagccgcctgacgaccaacaccttcagcctccattgccgagtcccccatcagtctgccgactgcgctctgcgccttgccggccagcttttctgctacaccttctacctgttcgctcttcatgattgatcaaccctgcgtgcatgagtggggaatgccgacagccctaaccgcgtggctggcagcacgacattaggggcgcacgccggatgattagttcaaagatgatgtggcccgacagttttcccctttggcaatagaacccctccaagtgagaagggtctgctcttgaatcactctcgagaatccatccaatgtccgcgcaacgcagccttgtcatactcgcccggggaggctacgccgctcgaggtgtgctttacctgatcatcggtatcttcgcgttgctggcagcccatgattcgacaaaacccaaggacagccacaggagcctcgaggccttgctggctcagccgttcggctattttctcgttgggattgtcgtagccggcctgctcgcttttgccgcctggcgtttcctgcaagcgacccgcgatgtcgaccatcacggcaaaaacctcaagggtttggtgattcgcgccggtctgttcgccggcggtctggtcaacggtgcgctggcattctttgcattgggcctgctgatcagcggcattaaaagctcgggcgcttccggcggccagagcaaggactggctggcgcattttttgtcttgggaagactcgaacttattggtgtacctgatcgcgctcattccgctgggtgttggaatcgctcacatcatcaaaggctggaaggcgtcattcgagcaatatttcgaggccgacgaagacgtcatgcgttacgtccgcccggtatcgcggttcggtctgatcgcccgtggcgtggtgtttatcgaaattgccgtgctgctggccatcagcggttccgcttataaagccatggacccaccgggtatgaaggaagccctcgacgccctgcagaacctgccagcgggatggctgattctaatggtgatggccgcggggctgattgccttctcggtttacagtttctctgaagcgttctggcgcaagatcaatatggatgtgccgggcgtctcaaggcagtagagcgctgcgccctctgttgaagcttttccagcccggcgggagtgtgactgcccacgctcggtgagcagtgcattcagtcagaaatccactgtggccgacagcagataagtcctcggtgtcgacaacgtcaaccccggctcactgtcatccgaggccccggccgaactccaataacgcttgtccagcacattctcgatattgccacgcaaggtgatggtcttgtcgtcaaccttgaaggcatagcgcgtgcccacgtcgaagcgctcccacgagtcgatctccttctcgttcgactgatccaggtactgcgaactcgaatagatgccccgcgttgtcagcgtcagcccctgcacggtcggcacgtcccactcggcgccgagattgacgttgtatttcggcgtcgccggcgcgcgattgccgtcgaaggtgccattcgtggtcttggtcaattcgctgtcgatgtacatcacgccaccgagcaaacggaagcctttaagcggttcgccgaatacgctcaactccacgccattgttctcgcgcttgccattggggccaaagacccgcgtggtggcgttggtttcataggctggttgcttgatgcggaacactgcagccgtcaatgcgtaggcgccggcgtcgtacttggcccccacttcaacctggcggctgataaatggcgggaagatttcgtcttcgtttatggaagtcgaaggcgcgatcttgccctgactcaaaccttccatgtagttggcgtacaacgacagtttgtcggtcgccttgaacagaatgccgcccgatggcgaaaccttttcctcgtcgtaagcagtgtcgcctttaacgtcatcgctccagtcatcaactttcacccgctgccagcgcgcaccgagggtcagcagcaagcgatcatcgaaaaagcccagggtgtcggacaacgccacgccgctgaagcggttttcggtgtagaccttggcgtcattgcgtgtcggcgtgccgggtttcgccgtttccaccgggtcatacaggttgctgcgcccagccgcgtaacgtgcgccgccgttctcgaaatccatgtagaagtagctggccgccagattgacctcgtgactcaccggcccggtgtggaaccagttgcgcacgcccgccgtggccgtgcgcacattctcgtcgcgggtaaaatctcgcggttgaacgctgaaatcaccggcgtcgttggtcacggaaacggcgtggcgcaagaagtcatgattacttttgcgcgcaccgacaccgccgtacagcatcaccgaatcattgacgtcgaactcagcgttgagcgtgccgaaggtgtcctcggttttcgcttggctccaaggttgcgcgtagttgcgatgcacgctgttcgcgctcggcaccttggcattggccgcgacctgcacgcgctcctgcggcgcgtcggtgtcgcgttcggtgtggccgatatcggtcgaaaggcgcaggcgttcaccgcgaaagtccaggcctagaacggccatgtcacggtcgacactttgatgatcccactcggtgtcgccggattgtttgacgccgttgaaacgcaggccaaattgattgtcctcgccgaaccgccgtccgacatccaccgcgccgccgacctgattgttcgaggcgtaattggccgtcagtgaggtgatcggtttgtcggaggcacgcttgggcaccacgttgatcccgccaccgacactgccccgtggcgaaatcccgttgatgagttggctcgggcctttgaggatgtcgacgcgatcggccatttccatgtcgatcgtgtaagtgggcagcacgccatagagcccgttgtaggcgacgtcgctgttgaacaggctgaaaccacggatggtgaactgctcgtatcggccaccggccgggttggtcgcgcgcaccgacggatcactggcaatcagatcgcccaaggtgcgcgcctgctgattcttcaccgcctcgctggtgtaggtggtcatgctgaacggggtttccatgaaatctttcgaccccagcaaaccctgcgagccacggcgcgcgacctggccgccggcaaacacatcagcatcactggaaccggtggcaccaagaatcgacgtcggcgccagttgcaggctgctgccctcggccgctggaatcagtgtgtaggcatgatcgcccagcggttgcagttgcagaccggaacccagcaacaagcgagcaaacccctcctccacagcgaattcgccggacaagccgttgctgttgcggccactcaccagcgccggatcgaccgacagattgaccccggccaacccggcaaagcgggtcagtgctgcactcaaactaccggccggcacctggtaactgcgccgagcggcgtcttcggcccaactggactggatcaacacagggctggcactcaggctcagcaggaggctcaattgcaacaacggacgcaaacgacttgggaatactgcgggcattggaagaagctctcgattttgttcacttacctgcaatgaccggtgaggcgaaaaaaagggacaggcttcagacgatattttttcgcggcgtcagcgtgacccagaaacgcgtgcgcgaatgcacctccaacggcaggctcgccgccagcagggccaggactttatcggtgtcgtcgagacggaaactgccggtgacacgcagaccttccagtgccggctcccagcgcaaaaggcccgagcgataacggctcaactcgcgcaggaaatcccccaacggctggttttgcgccattaacacaccgtcacgccaacccggcattttggcgtcgaacagcgcgatcggtgcggcgccggaggcctgcaaattgacctgttgcccggcgttcaactccagcgccgggccgtgcagcggctgcaattgcaccgagccgctgaccaccgacacgttgcactcacgctcgttgaggcgcacgcagacttcgctgcggctgacaatgatccgaccgtacggcgcgttgaccgtcaatgccgtgctacccggaacgttgagcgccatttcgccacgcaccaacgtcaactgacggctggccagatcgacgttcaccgcactggcggtgttcagttgcaaggtgctgccgtcggccaaccgtgttcgggtgtgctcgccagtggcggtctgtaaatcggcgcgccaaacgtcgagcggcaactggcgactgatcaaccacgccgcaggcaccaacgccgccagacccagcgctcgtttcagtgccgcacgccgcgccagatccgggcgatcgagtgtggccatggccaattctgtcggcagactggaaaagcgctggcgcagcaattgaatcttctgccaggcgttttcatggcggctatcgctgttgcgccaatgctgcagccgcgcgtgatcgtcatcggtagcatcaccggattccagtaacgccagccattgcgcagcggcacgtgcaacatcgcgcgcttgtacgttgggcgctattcgcatcatagatccaacatcaagcaatgctcgtaagccgttgccatataacgttttatagttcgttcagagacttgtagacgctcggcgatttcacggtaaccgaggccttccagctgactccagagaaatgtccgccgcactggccgtggcaagccatcaagcaattcatccagcgcgtgcagggtttccagcagcacccagcgctgctcgggcgacggcacgcactcctccggcaattgcgcgagggcttcgagataggctttttccagactgcggcgcgtgtagaaattgctcagcaggcgtttgcccacggtcagcaagtacgcgcgcggctcgcgcatatcggcaatcggctgagcgctgcacagcacgcgcaggaaggtgtcctgactcaagtccgccgcatcccacgcattgcccatgcgacgccgcagccaggtttccagccagcctcggtgatcgcgatacagttcgtgcaggtgctgcggcgatggcgtcgctgcttcagtcatctcaagagtcctgcgcgaagtcagtttcaaatgagagtgattctatttaacttgcgcgccgacacaaagcctttttatccacgacggcattcatgagcgcttcaaggtctcgctcggcaactccttgaacaacgcccggtaactgctggaaaaccttcccaaatgccagaacgaccagtgcatggcgacctccgccacggtggtctccgtgggccggcgcttgagcaattcgcggtgtgcactgttcaaccgacgcaagcgcagccagtgactcggggtcatcccggtgtaggccttgaacgcttgttgcaattgccgcaaaggtacccctgccacgtgcgacagttcgagcagattgagggtgtcttccggcgaatccgccgcccaccccccgacccgtttcatgatcattcgttcttcgctacgtttctgtaacccgccgcgatcaaggctggcatgagcgttgtcgaggatgaacaaacagtcttcgagcagctgctttgtcagcgaatctttatcaagcggatcaacagtttgcgacaacttcgtgagaatcgagcttaaccagcgactgaacagggcattctgtccgcaattgagttgcgtcatgaacaacccttcgagtttcgccacatccagaccgtgctgacggacaaactccggaccgaacaccacggcgatttcctgatagttctccggggtaatccagatgttgcggctctcttcattgagcaggtacagcgcgttgtcactgcgatcaaaacagaacgccaaagcacccgacggcgcactgaaattctgctcgacccgggtgttcatctgctcttcatagacctcgacgccctgcagatccagatagcggatctgcccggcaaaatgccccggcgacatctgttggtaatgctggacccagcccggtgtagcacggacctgttcagcgacatcggcggtgttgaacgcttggacttgtagcggattgcacattgtcatggggtgaccttgcgcactcttttggtgcgctttggtgctgcttaaagtggatagatggaactgcaaggctcgcccaagatagtcgtcaacgcgccacaggggaaggggcggaagatgaaacccgccctccccggcgtctataaaaccaataacgaggtctttatgaatgcccctttcgatcagctgttcacgtggctgaaagatcacaagattaccgaagtcgaatgtgtggtcagtgacctgaccggcattgcccgcggcaagatcgcaccgaccaacaagttcctgcatgagcgaggcatgcgcctgccggaaagtgtgttgctgcaaacggtaaccggggattttgtcgacgacgacatctactacgacctgctcgatccggccgatatcgacatggtctgcaagcccgtggctgacgcggtctacgtgattccatgggcgatcgagccgaccgccatcgtcatccacgacaccttcgacaagttcggcaatccgatcgaactgtcgccgcgcaacgtgctgaagaaagtcctgcagctctacaccgacaagggctggaagccgattgttgcgccggaaatggagttctacctgacccaacgttgcgaagacccggacttgccgctgaaagcgccgctgggccgctcgggccgtgcggaaagcggtcggcagtcgttctccatcgatgccgccaacgaattcgatccgctgttcgaagacgtctacgactggtgcgaactgcaaggtctggatctcgacacactgatccatgaagacggcccggcgcagatggaaatcaatttccgtcacggcgacgcgctggatctggccgaccagatcaccgtgttcaaacgcaccatgcgtgaggccgcgctcaagcacaacgtcgctgcgacgttcatggccaagccaatcggcgatgagccgggcagcgccatgcacattcaccaaagcgtggtcgacaccgccaccggcaagccggtcttcgccaatgacgacgggcaaatgagtgaattgttcctgcactacatcggcggtttgcagaagtacatcccgaaagtgctgccgatgttcgcgccaaacgttaactcgttccgccgcttcctgccggacacctcggcaccggtcaacgtcgaatggggcgaagaaaaccgcaccgtcggcctgcgtgtgccgacctccagccctgaagccatgcgcgtcgagaaccgtctgccgggggccgacgccaacccgtatctggcgattgccgccagtttgctctgcgggtacatcggcatggtcgaaggcatcgcgccaagcgccgccgtacaaggccgcgcctacgaacgccgcaacctgcgcctgccgatcaccatcgaagaagcgctgacgcaaatggaagagtgcgaaaccgtcgcgcaataccttggcgacaagttcgtgcgtggctatgtcgcggtgaagcgtgccgagcatgaaaacttcaagcgcgtgatcagctcgtgggagcgtgagttcctgatgctgagcgtctaacccaagctaaaagatcccctatgtcgatcgttcccacgctctgcgtgggaatgcagcccgggacgctccgcgtcccatccagagccgaacgcggagcgtccgttgaggcattcccacgcagagcgtgggaacgatcagtcagcgagccaactcattcatccgctggagcacggcgttaaggccattgctgcgcgacggcgatagctgccgcgaaaggcccaactgattgaaccagtccgacagatcaacctgctgcaattcagcggccgacaagccgttgacccgcaacagcaacaacgccaccaacccgcgaatcatccgtgcatcgctactcgccgcgaactgccagtgaccatcgcgcaacgccccgaccagccacacctgactctcacagccatgcacccggttggcctcgcacttgtccgcgtcatccagcgccggcaatcgatcaccaatctgcatcaacaaccgcgcccgctgttcccagcccgctgcattctgaaaagtctgcagcgcttcaactgcctcgaccggcaggctcatcgcaacaactccagcgcctgatccagggcttcaaagaaacgctccagatcctccgaatcgttgtacaacgccagcgacacgcgaatcgccccggccagctcgaagcttttcaacagcggcatcgcgcaatgatgtccggcgcgcacggcaatgccttgctcggtcagcagatgcgccagatcagcgttatgcacaccttcaacgacaaaactcgccagcgccagttgcggcttgccgagcaagcgaatgccgttacgcgccgcgagtccacgcagcaaatagtcatgcagcgcggcttcatgggcggacaccgcgtcctgatccagacccgccagataatccagcgtcgcgccaagaccgatcacactggcaatcggtggcgtgccggcttcgaaacccaacggcgcagggcggaagcgcgcgtcgtgatagttggcttccagcaccatctcaccgccgaactgccaaggcttcaattgctcaagcgcagcgttgcgcccgaacaacacgccgaggccatcaggcccatagagcttgtggctggaaaacacatagaagtcgcaacccagcgcctgcacgtcatgccgaccatggacaacgccttgcgcgccatcgaccacggtcagcgcgttctgcgccttggccatgcccagcaaggccggcaatggctgccacgaacccagcacgttggacaactggctgaccgccagcaatcgcgtgcgcgggccgatgaggtgcacagcggcagcaaggtcgatcagaccgtcggcatccagcggcagaatcaccagcttcagattgcgccgttgcgccagttgctgccacggcagcaggttggcgtgatgctccagggcgctgatgacaatttcatcgcccgggtggaaaagatgttccaggccataagccaggaggttcagcgcactggtggcgccgtgggtaaagatgatctgcccgctgtcaccggcattcagccactgggcaaccttgagtcgactgtcttcgaacgcctgcgtcgcgtgagcgccgggcaggtgttgcgcacggtgcacattggctgcgccgttggcgtagtaatgcgtcagtgcgtcgagcagggcttggggtttttgcgtggtggcggcgttgtccagataggtctggtcttgccgttgcagtgcggcgatggccgggaagtcggcgcgccacggggagggaatcatcacggtctttagccctggtgaagaggggcgggatgtacgccaaatcctggaggagtgagcctgctcgcgatggcgtccgtgagggcgctaaaggcatcgcgagcaggctcactcctacaatggattatccaagcacttagttgtgagcgtgcagcgcttcattcagctcgatcgccgatttgtgggttttgcattccacagcaccggtttccgaattgcggcggaacagcagatcagtctgaccggccagttcacgcgccttcacgactttaaccaggttgttgttttcgtcgagcagcgcaaccttggtaccggcggtcacgtacaggcccgactcgacagtgttgcggtcgcccaacggaataccgataccggcgttggcgccgatcaggcagccttcgccgaccttgatcacgatgttgccgccgcccgacagggtgcccatggtcgagcaaccgccgcccaggtccgaacccttgccgacgaacacgccagccgatacgcggccttcgatcatgcccgggccttcggtgccggcgttgaagttgatgaaaccttcgtgcatcacggtggtgccttcaccgacgtaagcgcccagacgcagacgcgcggcgtcagcgatacgcacgccggccggaaccacgtagtcggtcattttcgggaacttgtccaccgagaacacttccagcagctcgccacgcagacgggcttccagttgcatttccgccagttcgctcaggtcgatggcgccttggctggtccacgcgacgttcggcagcagcgggaagatcccggccaggctcacgccgtgtggcttgaccagacggtgcgacagcaggtgcagcttgaggtaggcctcaggtgtagaggtcagctgtgcgtcttcggccagcagggtggcgaccagcggcttgtggctttcagccagacgggtcagcagcttgccttgcacggcatcgatgcctttcacggcttctgccagttgcgcagcctgagcggtggtgaaggtgatggcctggttgccttcggtgtaaccgaggattggcgcaaccgccgcgaccagctcggccgatgggttgagcagtggctgtgcgtagaacacttccagccacgcgccttgacggttctgagtgccgacaccaaaggcgatgctgaacagggaattggacatgtaaatacacctctacaaagagtgacgggctgcttacttcagagcggccgcgtagatatctggcttgaagccaatcagggttcggtcaccgagatcgagcaccgggcgcttgatcatcgagggttgagcgagcatcagttcgatggctttcgactggtcgagatcggctttgcgttcgtcgtcgagtttgcgaaaggtcgtgcctgcgcggttcaacaccgtttgccagccatgctcgtcacaccattgggtcaggtgttcacggtcgatgccggcggttttgtaatcgtgaaagtcgtagctgacagcgtgctcatcaagccaggtgcgcgcctttttcatggtgtcgcaggctttgatgccgaaaaggtgcaacgttttacttgaaacggtcaaggaattgccccctttacaggtgctggagaaaaatggtgtcggattatgccatgaccaaacggtttcgtcggccacggttgtcgtaacgctgcaaaacctgtgggagcgagcctgctcgcgaaggggccgtgtcaggcaatatctctgttgaatgacacaccgcattcgcgagcaggctcgctcccacaaggggactgcgttccagcagctgcgacataggtgcaagggtcagacgcatgctaaacggctaatatggcagttcaacgctgtcgattgtctgagatttccgctttatgcaaaccgcttacaccgtcctgatcctgctgatgctggtcagcgtctcgcgtctggtcggacgggtcatcccgttgccactgccactggtgcaaatcgccgccggcgctttgctcgcctggccgaccctcggtctgcatgtggcccttgatcccgaactgttcctgtttctgttcctgccaccgctgctgttttccgatggctggcgcatgcccaaacgcgagttctggcatctgcgcgggccgattctgacgctggcggtgggtctggtgctgttcaccgtggtcggtgccggctacttcattcattggttgatgccgagcattccgctggcggtggccttcgcactcgccgctgtgctgtcgccgaccgacgcggtggcggtctcggcgatttcacagaatcgcttgccgacgccgctcatgcatatcttgcagggcgaagcgttgatgaacgacgcctcgggcctggtgaccttcaaattcgcgctggccgcggcgatcaccggagcgttctcgttggccaatgccagcctgacgtttgtgctggtggcagtcggcgggctggcagtcggcgtggcactgagctggctggtcgggcgcttgcgcgcgtggatgattgcccggggctgggacgatccggctacccacgtggtgttcatgttgctgctgccgttcgccgcgtatgtactggccgagcgactgggtgcctcgggtatcctttcggcggtggcggcggggatgatgcagagctggctcgatctgctgccacggcagacgagcacccgcctgctcaaccgcagcgtctggtcgcttctggaatttgctttcaacggattgatctttctgctgctgggcctgcaattgccggacatcatcaaagcggtggtcagtcacgaaccgacgttatggccgaccctgttctatcgctgtctcgacgtggtggcgatctttcttgcattggtcctgctgcggttcatctgggtgcagagcatctggcgcttgtcggtgctgctgcggcgtttgcgtggcaagaacgagctgactcaggtgccgacagcgcgctcctgctggctgttgacggtcggcggcgtgcgcggtgcggtgacgctggcgggtgtgatgtcggtgccgatgttgatgggcgcggaggcgtttcccgagcgtgatctgctgatcttcatcgctgccggggtgattctgctgtcgctgatctgcgcctgcatcgccttgccgttgcttttgcgcggcattgagaaaagcccggacgacaagcggcgccaggaagtgcgcgacgcctggcgcaagaccgccgaggcagcgatccatgcgctggaaaccgaggaggtcggcccgcaggatgcagcgcaggccgcactcgcggcagaactcaaggcgcggatcatgtccgagtaccgccatcagctcgatgtcttcaacgactcggccgaagcacaggccctggcgtttcagatggatctgctcgagcgtcgtttacgcctcaaggctctgcgcgcgcaacgtctggaactctacagcctcagccgtcatcaccagatcggtgatgacgtattgcgcgaggtattaggtgagcttgatttgagtgaggccaatctggggacgttgaagtagtcccgcatgggtgttgatcggattgcgggttttatcggggataaacggttcgcgccatgtgtatatccaatctacttagttcggtgttttcagtgacctcaaatactccgtcggtgaaggttttttctatcggatagtgcatgatcgacttttgatcataagcggtcacagacatcttttgattgatcttggtgaagaagttttcgtcaatggcggctctgctcatgccgagtcgagtgaagtggtcgtaaaccttttgcttgttccaggggatgttggcgtacgggtgcaaatgctcgtgttcgaagcccagggcgtggccgaactcgtgcagtaataccgttctgaatctgctgctgcctggcttttcggcaatgtacatcgttggattctgcacatcgacggtgagtgcgtctgtgccaacggcagagctgttgtcactggttttggtcttgatgcgaatgtcggcatcgcgctcgctcgtgaacacgatatccaggttgatatggttaccccattcccgaatgacttcccgatactgcgtttgctcttcgttcgtcaggttatcgagaaacgtgacgctaagcgtcctgaacgctttccatacctttccatcaagggccacgcccagtaaggaaataccctgcctgctgacgttggcagggttctcggcaagcgcggcctgataggaaagactttggcttttcggcggcagtgtcgtgcagattttgcagtctggcattcttgaagtcctttttaagtaatgcatgaggtaggtggttttgatgaagcctgacgtcctgtcaggcatcggggtgtggataagcggcggccatgaaagccttgtctttgtcgctgagctgcagattcagctgaatctggaagtcaccctgggtccagctctggcggatggcgtagtgcatgatcgacttcgggtcgtaagtcgagttgtcgacttcactggcatcgagaagattgaaatagcgctcgtcgatgttgctgcgagccagatcatcatcttctgcgccaaagtgctcgtagacggcttgcttgtcccagggaatggtcatttgtgggtgcagatgttcatgttcggcacccagtacgtgaccaaactcatgcaaggcattggccatgaagaacttgggcgacaagttgtgatcaggcgaaagattcatggttgcttcgctttgatcatcttgggtcaatgcgtcagtaccgatcagcgaccagtagtcgccgttgtcatcggatatgcgaatttcggcatcgccttcatcaacaaagtcgaagttcagattgataaacgctgtccatgttgctgccgccgcgcagatggcttgcttgtaggctgcgtcacccgctagcacgcgaacgcgcagggttcggccgggtgcccagagtttgcggtgcttgatcgcggctcttttctgacgaccgccggacgtaccgcgattggcggagttctcgttgatggccgcttggtaggacacattaatgtcttgcggtgctttaacaagacaatcttttatatcatccatgaattactttccgtagttgatgatttgctgtttggtttattaatggggtttgatatttaaacaaccaggttcagcttgagcggacagagtaagtatcgatgggggagataggaagatgaaagaagagttgatgtgttgcgtagtgtttgtttccgcacgacattgcgtcgtgcggaaaaatataaacgcttgttagcgacgcttgatgaagtcgcgaatacgttccgcagcctcgacacattctgccagcggcgcaaccagcgccatgcgcacgcgacctgcgcccgggttgaccccatcgacatcgcgggacaggtaagaacccgggactacggtcacgtgttcctgttcgaacagatcgcggcagaacgcagcatcgtcatcctgcacgttcggccacaggtagaagctgccatccggacgctggacgtccatcaccggactgaggattgccagtacggcgtcgaatttctcgcggtacagcgcgcggttggcgcgaacgtggacttcatcgttccaggcggcaacagaggccaattgggtttgtaccggcatcgcgcagccatggtaggtgcgatacagcaggaagcccttgaggatattggcgtcgccggcaacgaaaccggaacgcaggcccggcaggttggagcgtttggacaggctatggaacaccacgcagcgtttgaaatccttgcggcccaactcaacgcaggccgtcagcaggcccggcggcggggtctgttcttcgaaatacagttcgctgtagcactcgtcggcggcgatcacgaagtcgtattcgtcagccagggcgatcagtttctttaatacatcgaccgggatcagcgcgccggtcgggttgcctggcgagcacagaaaaaggatctggcagcgcttccagatgtctggcgacaccgcatcgaaatccgggttgaagccgttctcgtcaaggcacggcagatagtgcggtttggccccggcgaggaacgccgcaccttcgtagatctgatagaacgggttcgggctgactaccagagcgtcatcaccgcgattgactacggtctgggtgaaggcgaacagcgcttcgcgggtgccgttgaccggcagtacgttacgcgccggatcgatccagccgcttggcacgccaaagcgacgctcgcaccagccggcgattgcttcgcgcagggccgggatgccgagagtggtcgggtagaccgccatctgatccaggttgttcgccagcgcttcggcgacaaagctcggcgagcgatgtttcggctcgccgatcgacagggcgatcgggcgtttgtccgggttcggggtcacggtgccgagcagggcgcggagcttttcgaacgggtaaggctggagctggttcagagcgttgttcatgggggcctcgttgaatgtgggagggattgcctcaatacccgccatccacaaaacctgtaggagtgagtctgctcgcgatgaggaaggctcattcaatatctatgcagctgatgaaccgctatcgcgagcaggctcactcctacaaggggtttgttgaacaggctggtatcggagtcttccttcccacaggagtaatggttacttcaattcaaatactgatacgcgaaagcttgatatcgggttcctgattgacgctcaactgctcaacgatcgcatcctgcaggcggctgcacagcagcgggtcggacagcggctgattgtgcgcgtcggtgatgaagaacacgtcttccactcgctcgcccagggtcgcaatcttggcgttctgcagcgacaggtcgaactcaaggaatatcccgccgatccgcgccagcagtcccgggcgatcaggtgcggtcaattccagcaccgtcaccgggcgttgcgcgtcgttgtggatcgtcacttgcggcgcaaaggcgaaatgcttgagctggcgcggcacccggcgctgaatgatcgtcgggtagtcatccgggttgcgcagggcttcggtcaggccttcgcggatctgcttgacccgcgccgggttgtcgccgatggattcgccttcgttgtcgagcacgatgtaggtgtcgagggtgaactggctgctcgacgtgatgacccgggcgtcgtgaatgttcaggttgagctgatccatcgcggccacggtcacggcgaagaagtcatgctgatccggtgcataaatgaagatctgcgtgccgccctcgaactcgcgctgagtggtttccttgatcagtaccagcggcccgccatcgacgggctgctgcaggatcgcgtcgctgtgccaggccacatcgccagcggtgtggcgcaggaaatagtcatcacccaactgcgcccataactgctcgacgtcgtccggatcggtgccgcctcgcaccagaatatccagggccgcgctttgggtctggcggatctgctcttcgcgatccaccgggttttccagaccacgacgcagggcacgtttggtctcggtgtagagctggcgcaacaggctcgcgcgccacgaattccacagtgtcgggttggtcgcgttgatgtcggccacggtcagcacgtagaggtagtcgagacgggtttcatcgccgaccgccagggcaaaatcgtgaatcacctgcggatcggacaagtccttgcgctgggcggtggtcgacatcaccaagtggttctgcaccagccagacgatcaggcgactgtcccacaccggcaactgatggcgctggcagaacgcttcggcatcgaccgcgccgatctccgagtggtcgccgtgtcgacccttgccgatgtcgtggtacagaccggccatgtagatcagttcgggcttgggcagtttggccatgagtttggcggccaacggaaatttttccgacacttgcgtgtactgcaatttgcgcaggtgcttgatcaagttcagcgtgtgcgcatcgacggtataaatgtggaacaggtcgtgctgcatctgcccgacgataaagccgaactccggcagataacgcccgagaatgccgtaacggttcatccggcgcagattgcggtggatgccgatcttgcacttgaacagctcgatgaacaggctggtgttgcgaatatcgttgcggaaagtgtcgtcgatcagatgacggttctcgcgcagcaggcgaatggtatcggcgcgcacacctttgatttccggctgctgggccatcagcacgaagatttcgagcatggcgaacggtgtgcggcagaacacattgtcgtttcgcgcttcgatgtagccatcgtgcagctggaagcgcgagttgatcggctgtggcggggcttcgtcttccggcgcgaggatgacttcttcgaaatgctgaatgatcaggtcgctgagctgggcgatgctcatcaccacgcgaaagtattgctgcatgaagttttcgaccgcttgtttcgcgtcgtcaccttcaaaaccgagcaaaccggcaatggtgcgctgatgatcgaacagcaagcggtcttccgagcgacctgccagcatgtgcagcgcatagcgcactttccagagaaattcctgggaggaggcgagcagggcgttttcgctctcgaccaagaagccttcaccggcgagggcgcgcaggttgagcgtgccgtattggcgacgcgcaacccagagaatcgtctgaatatcccgcagtccgccgggcgagcctttgacgttgggttccaggttgtattcagtgtcgttgtatttgtggtggcgggctttttgctcggcgcgcttggccaggaaaaactccttggccggccacatgtgggcggtgctggtgacatcgagcatgcgctggcgcaggcgctcggggccgcaaatggtgcggctttccatcaggttggtaaccacggtcagatcggcgcgggcttcttcggcgcattcatcgaccgagcgcacgctctgaccgacttccaggccaatgtcccacagcagcgtcagaaaacgctcaatggagtcacgaaagacttcgtgatcggcgctgtccagcaggatcagcagatcgatatcggaataagggtgcagctcaccgcgaccatagccgccgaccgcgaccagcgcgatgtcggcgtcttcgctccagttgaactggtcccaggccttttgcaggatgttgtcgacgaaccaggcgcggtcttcgatcaggcggcgaatgtcgcggccattgcgaaaacgcgtgtcgagtacctcgcgagcctggcggatcgccttcttgaacgccgcgataggactcgctttcagggccagttcagcctggaactggccgcggtcgaagagttcgggatccacctgcggcatcgattggctttccttttataaggctgggagcggtgtgtggatcaggccgagatgcgcgggatggtatcgtcagcgcgcagggtgaagatctcgtagccggtgtcggtgaccagcagggtatgttcccactgcgccgacagcttgcggtccttggtgattgcggtccagccgtcacccaatactttggtgtcggccttgccctggttgatcatcggctcgatggtgaaggtcatgccggccttcagttccatgccggtgccggcgcggccgtagtgcagaatctgcggctcttcgtggaaaaccttgccgatgccatgcccacagaactcgcgaaccaccgagaagccgttcttttcagcgtgtttctggatcacttcgccgatgtcgccgaggcggcagccgggtttgacgatttcgatcgccttgtacatgcattcctgagtgatctgagacaggcgctcggcccagaccggtacttcgccgacgtggaacatgcggctggtgtcgccgtggtagcggtccttgattacggttacatcgatgttcagggtgtcgccgtttttcagcggcttgtcgttcggaatgccgtggcagaccacgtggttgatcgaggtgcagatcgacttcgggtagcccttgtaattcagcggggcagggatggcctgctgcacgttgacgatgtagtcgtggcagatctggttcagctcatcggtggtgatgcccggttttacgtgttcggcaatcatttccagcacatcggcggccagtttgccggcgacacgcatgccagcgatgtcctcgggagttttgaggttgacggtcatacaggctctctctgcgctcggcggcgcttgctggtacgaatggggtggcaagtgttcgttttgcgaccctgaaaaacgcgattctaacagacgcgcggcgcaattcagcgcctgcgtgcatcgcttctctctatacaatggtgcccctgaagccgattccaagggggctgcgcccatgtccttggtgcgaatacagatttcgtgttccgtttctgcgcaccctgtggtataaaatgcgccgctttccggggataccccgagaagcttaaatccacacacgtgtcgacacgatgacctgggtgcttttggctttatgccactggttggtcattgggatacgtggaggccaaacccgacttattaaggaactatcatgtcccaagtcaatatgcgcgatatgctgaaggccggtgtgcacttcggtcaccaaacccgttactggaatccgaaaatgggtaagtacattttcggcgcgcgtaacaagattcacatcatcaaccttgaaaaaaccctgccaatgttcaacgaagctctgactttcgtagagcgtctggcccagggcaaaaacaagattctgttcgtcggcaccaagcgttccgctggcaagatcgttgctgaagaagcagcacgttgcggttcgccgtacgtcgatcaccgctggttgggcggcatgctgaccaacttcaaaaccattcgtgcttccatcaagcgtctgcgtgaccttgaagttcaagccgaagacggtactttcgccaagctgaccaagaaagaagcgctgatgcgctcccgtgatcttgagaagctggatcgttcgctgggcggcatcaaggacatgggcggtctgccagacgcactgttcgtgatcgacgttgaccacgagcgcatcgcgatcaccgaagccaacaagctgggcatcccggtaatcggcgttgtcgataccaacagcagcccggaaggcgttgactacatcatcccaggcaacgatgacgcaatccgcgctatccagctgtacatgggttcgatggctgacgcagtgatccgcggtcgcaacaatgtttccggcggcactgtagaattcgcagctgaagaaactcaggctgcagctgagtaattgacgccctggcgttgactcagtaagcaaaaagggggcttggccccctttttgccacctcgaaaaccatttgtcggcgcccgcggcactatttgtaatgtgcggcagctaacaagggtggttcgggaagaattgaacgcccgttcgatcgggtggaatggttgaaaacctatccaagaggaatttgaaaatggcagcaattactgcagcgttggttaaagaactgcgcgagcgtaccggcgaaggcatgatggattgcaagaaagccctggaaaaggctgacggcgacatcgaaaaagccattgatgacatgcgtgcttcgggcgcgatcaaagctgcgaaaaaagctggcaacgttgccgctgaaggcgcaatcgctatcaaggacgacggtaaagctgccgttatcctggaagtgaactcgcagaccgacttcctggctctgcaagacgacttcaaaaactttgttgctgccagcgttgaaaaagcgttcgctgacaaactgaccgaagctgctccgctgatcgctgctcaagaagccgctcgcgaagcactggttgccaaagtaggcgaaaacgtcaacatccgtcgtctgacccgtatcgaaggtgacgttgtaggttcgtacctgcacggcaacaagatcggtgtggttgtggctctgaaaggcggtgacgtcgagctggccaaagacatcgcgatgcacgtagctgcaagcaatcctgagttcctgctgccttcgcaggtttcggctgaagcgatcgagcgtgaaaaagctgtgttcctgcagctgaacgaagagaaaatcaaaggcaagccggaaaacattgttgagaatatggtcaaaggccgtatcagcaagttcctggcagaagcaagcctggttgagcaggcgttcgtcaagaaccctgaaatcaaggttggtgagctggccaagaaaggcggcgcagaaatcgtttccttcacttactacaaagtaggcgaaggcattgagaagccggtcgacaacttcgctgaagaagttgctgcccagctggctgccgccaagcaataagacggttttccaactgtcgcccgaaagaggctgcccgcttacgcgcgcagcctcttttcagatggggttgccaatttttaattggtttccacttggaactgacttacaaagccatgttccgatggcgctgaagcagcgccaagctagagtgaacgccagctgtaaacagctcgcaaagaatttttaaatacgccgcaggagagattcgcaatggctcagcagggcagtggttatcaggctcgctataaacgcattctactcaagcttagcggcgaggccctgatgggctcggaagagttcgggatcgatccgaaagttctcgatcgcatggcgctggaagtcggccaactggttggcatcggcgtgcaggtcggtctggtgatcggtggcggcaacctgttccgcggtgaagcattgagcaaagccggtatggatcgggtgacaggcgaccacatgggcatgctggccactgtgatgaacgccctggccatgcgcgacgcgctggaacgtgccaatatttcggccatcgtgatgtcggccatttccatggttggcgtgaccgatcattatgatcgccgcaaagccatgcgccacctgaactccaaggacgtggtgattttcgcggccggtaccggtaatccgttcttcaccacggattcggcagcctgcctgcgtgcaatcgaaatcgatgccgatgtcgtgctcaaagcgaccaaggtcgatggcgtctataccgctgacccgttcaaagacccgcatgccgagaagttcgatcatctgacttatgatgaagtgctggatcgcaagctgggtgtaatggatctgacagctatttgcctgtgccgcgaccacaagatgccgctgcgcgtattcaacatgaacaagcccggcgctctgctgaacatcgtacatggcggcgctgaaggcaccctgatcgaggaaggtcaacaatgatcaacgaaatcaagaaagacgctcaagagcgcatgcagaaatccctggactctctggcccacgctttcggtcagattcgtaccggcaaggctcacccaagcattctgggtagcgtgatggtgccttactacggcactgataccccgctgagcggcgtcgccaacgtcaccgtgaaagactcgcgcactcttcaagtcgtggccttcgagcgcaatatgctcgctgccgtcgataaagcgatccagagcgctggtctgaacctcaatccgaccaaccttggcgagttgctgttgatcccgatgcctgccctcaccgaagaaacccgcaaaggtttcaccaagcaggcgcgtagcgcagcggaagacgcccgtgttgcggtgcgcaacattcgtcgcgatgcgctgggtgatctgaagaagctggtcaaggacaaggaaatcagcgaagacgaagagcgtcgtgctgtcgctgatatcgacaagctgaccaaagatgccgaggcccagatcaccaaggccacggacgagaaagaaaaagacctgatggccgtataagggtcgagctttaaatggacaagaccaagcagactgcgccgtccgcggtgccgcgccatgtcgcgatcatcatggatggcaataatcgctgggcgaaaaaacgctttatgccgggtgtcgccgggcataaagcgggcgtggatgctgtgcgtgccgtcatcgaggtgtgtgccgaggccaaggtcgaggtgctgaccctgttcgcgttttccagtgagaactggcagcggccggccgatgaagtcagtgccttgatggatctgttcttcaaggcgttgcgtcgtgaggccaagcgcctcaacgacaacaacataagcctgcgcatcatcggcgatcgttcgcgctttcatccggaacttcaggcagcaatgcgtgaagctgaagcgatgacggcgggtgccaaccgtttcatcctgcagatcgctgccaattatggcggtcagtgggatattgcgcaggctgctcagcgtctggcgcgtgaagtccaggccgggcacctgcgtccggaagacatcaccccggatctgctgcaaacctgtctggcaactggcgacctgccgttgcctgatctgtgcattcgtactggcggcgagcatcgcatcagcaacttcttgctgtggcaactggcttatgccgagttgtacttctccgacctgttctggccggacttcaaacacgatgccatgcgcaatgcgctggctgattacgcttcgcgtcaacgtcgtttcggtaaaacgagcgaacagatcgaagctggagcccgggtttaatgcttaaacaacgaatcattactgcgctgatcctgctgccgatcgccttgtgcgggtttttcctgcttgaaggttcgggctttgcactgttcatcggtctggtcgtgagcctgggtgcctgggaatgggcgcgtctggcgggtttcactgcgcaagcgttccgtgtcggctttgccgccgtggtcgccttgatgctgttcgtcatgtacatcctgccgggccttgcgccatgggtgttgggtgcgtccgtgttgtggtgggcggtggcgacctggctggtactgacctatccgcgttcgagcgggcactggtccagtgccgcgagcaaactggtcattggtctgttgattctgctgccggcctggcaaggtcttgtgcagctcaaacagtacccgctgggtaactggctgatcatggcggtgatggttctggtctggggtgctgacatcggtgcctacttttccggccgggctttcggcaagcgcaagctggcgccacacgtcagtcccggtaaaagctgggaaggtgtctatggcggtctggcgctgagtctggtgattaccgcgattgtcggcctggtgcgcgactggacggtggccgagttgctcaaagggctgatcggcgctgcattgatcgtattcatttcggttgtgggcgatctcacggaaagcatgttcaagcgtcaatccggcatcaaggacagcagtaacctgctgcctggccatggtggcgtgctcgatcgtatcgacagcctgaccgcggccattccggtatttgcagtgttgctgtggatggctgcaccttgagccgtccacagcagatcactgttctgggggcgaccggctcgatcggtttgagtactctcgatgtcattgcgcgtcatcctgagcgttatcaggtgtttgcgctcagcggtttcactcgactgagtgagttgttcgctttgtgcgtgcgtcatgtgccgcagtacgcggttgtcccgcaagcagaagcggcgcgcagcctgcaggatgacttgcgggcggccgggttgccgacccgtgtgctggtcggggaggagggcttgtgccaggtcgcagcggcccctgaggtcgatgctgtcatggcggccatcgtgggtgccgccgggctgcgtccaacgctggcggcggtcgaggcgggcaagaagattcttctggccaacaaggaagcgctggtaatgtccggcgccttgttcatgcaagccgtacgtaaaagcggttcggtgctgctaccgatcgacagcgaacacaatgcgattttccagtgcatgccgcaggatttcgctcgcggattgagtgctgtaggggtgcgtcggattttgctgaccgcttctggcggtcctttccggcagacgccaatggccgagttggcgcacgtttcgcctgatcaggcctgtgcgcacccgaactggtccatggggcgcaagatctccgtggattcggcgagcatgatgaacaaaggacttgaattgatcgaggcctgctggctgttcgatgccaagcctgcgcaggtcgaggtggtgattcacccgcagagcgtgatccattcgttggtcgattacgtggatggttcggtgctggcgcagttgggcaaccccgatatgcgtacaccgattgccaatgcgctggcctggcctgaacgcatcgactccggtgttgcgccgctggatctgtttgcgattgcccggctggatttcgaagcgccggatgaagagcgctttccatgcctgcgtctggctcgtcaagctgctgaagcaggcgacagcgcgccggcgatgttgaatgcggccaatgaagtcgccgtagcagcgtttctcgacggacgggttcgttacctcgaaatcgcgagtatcatcgacgaagtcttgaatctcgaaccggtggtcgcactggatgatctcgaaacagtgttcatcgcggacgcgaaagcgcgagtactggctgaacagtggttgagtcgtcacaaccgataggttttgcaacacaatggctacacgcggcactgaacaggattgcggagaaagtagatgagcgcgctctatatgattgccggcaccctgatcgccttgggagtgctggtcacttttcacgaattcggccatttctgggtcgcgcgtcgctgtggcgtcaaggttctgcgtttttccgtaggcttcggcatgccgctgctgcgctggcacgacaagcaaggcaccgagtttgttgttgccgcgatcccgttgggtggctacgtcaagatgctcgatgagcgcgaaggcgaagtaccggtcgatcagctggatcagtcgttcaatcgcaagtccgtgcgtcagcgtatcgctattgtggcggcgggtcccatcgccaactttctgttggccctggtgtttttctgggtgctggccatgctcggcagcgagcagatacgtccggttatcggtgcggtcgagtccggcagcatcgccgccaaggctggcttgacttcaggccaggaaattgtcgccatcgatggagagccgacgtcgggttgggcggctgtcaatttgcagttggtgcgtcgtctcggcgaaagcggttccttgcagttgatggtgcgcgatcaaggttccaccgcggattcgccgcgtgaactggcgctggatcactggctcaaaggtgccgatgagccggatccgattcgctcgctgggtattcgtccatggcgtccggcactgccgccggtacttgccgaacttgatccgaaaggtccggcgcaggcggcgggtctgaaaaccggtgatcgtttgctcgcccttgatggtcaggcgctgaacgactggcagcaggtggtcgataccgttcgtacgcgtcctgataccaaaatcatgctgcgcatagagcgcgacggtgctcaaatcgacgtcccggtcaccctcgcggcgcgcggtgaaagcaagtcgccaagcggatatctgggcgctggtgtaaaagctgtcgactggccaccggagatgatccgcgaggtcagttacgggcctttggccgcgattggcgagggcgcccgtcgtacttggaccatgagcatcctgacgctggattcactgaagaaaatgctcttcggcgagctctcggtaaaaaacttgagtggaccgataaccattgctaaagtggcgggcgcttctgcccagtcgggcgtcgctgatttcctgaatttccttgcttatctgagtattagcctgggcgttctgaatttgctgcccattcctgtactggatggggggcatttgttgttttatctgatcgagtgggcgcgtggtcgtcccttgtcggatcgggtgcaaggttgggggatacagatcggtatcagtttggtggtcggagtgatgttgcttgctctggtcaacgatctgggtcgactgtaacgcttcgctgaattgcgaatctgccgcattttgcggcagtttgtttattgccagttggaataagaaaggacttcatgaaacgtctgctgctaactgcggttctcaccgtattgatgatcgccgaagttcacgccgagtccttcactatctctgatattcgcgtcaatggcctccagcgggtctccgcgggtagcgtctttggtgccttgccgttgaacgtcggcgagcaggcggatgatcgtcgcctggtggaatccactcgtgcgttgttcaaaaccggtttctttcaagatatccagctgggccgcgaaggcaacgtcctggtaatcacggttgtcgagcgcccatccgtcgccagtatcgagatcgaaggtaacaaggcgatctccactgaagacctgatgaagggcctcaagcaatccggtctggccgaaggcgagatcttccagcgtgccaccctcgaaggcgtgcgtaacgaactgcaacgtcagtacgttgcgcaaggccgctattcggctaccgtcgataccgaagtggtatcgcagccgcgtaaccgtgtcggtctgaaagtgaagatcaacgaaggcaccgttgcggctattcagcatatcaacgtggtaggcaacacggtgttccccgaggaagacctgaccgacctgttcgaactgaaaaccaccaactggctgtcgttcttcaagaacgatgacaagtacgcccgtgaaaagctttccggcgacctggaacgtctgcgctcctactacctggatcgtggctatatcaacatggatatcgcttcgacccaggtgtccatcaccccggacaagaagcacgtctatatcaccgtcaacgtgaccgaaggcgagaagtacaccgttcgtgacgtcaagctcagcggtgatctgaaagtccctgaagatcaggtcaagtccctgttgctggtacagaaaggccaggtgttctcgcgcaagctgatgaccaccacttccgagttgatcacccgccgtctgggtaacgagggttacaccttcgccaacgtcaacggcgtacctcagccacacgatgaagaccacactgtcgacatcctgtttgctgtcgatccaggcaagcgtgcctacgtcaaccgtatcaacttccgtggcaacaccaagtccgaagacgaagtgctgcgtcgtgaaatgcgccagatggaaggcggctgggcttcgacctacctgatcgaccagtccaagacccgtcttgagcgtctgggcttcttcaaggaagtcaacgttgaaacccctgctgttccgggtgtcgacgaccaggttgacgtgaactacgccgttgaagagcaggcttccggttcgattaccgccagcgtcggttttgcgcagagtgccggtctgatccttggtggttcgattacccagaacaacttcctcggtaccggtaaccgcgtcagcgtcggcctgacccgaagtgaataccagagccgctacaacttcggctacgttgacccgtactggaccgccgatggcgtgagcctgggctacaacgcgttctatcgcaccaccgactacaaagacctcgacgtcgacgtagcaagctatgcggtagacagcctgggcgctggcgtcaatatcggttacccgatcagcgagacttcgcgcctgaccttcggtctgtccgctcagcaggacgagatcaagaccggtacttacaccgttgacgagattttcgacttcgttaacaaggaaggcgacaagtacctgaacttcaaggcctcggccggctggtccgagtcgaccctgaacaagggcgtattgccgacccgtggtcgttcccagagcctgaccctggaatccaccattccgggcagtgacctgtcgttcttcaaacttgattaccgtggtcagctgttccagccgatcaccgagaattacaccctgcgtctgcataccgaactcggttatggcgacggttacggttcgactgacggcttgccgttctatgaaaactactatgctggtggtttcaactcggttcgtggcttcaaggacagcaccctcggtccgcgcagtacgccaagccgtggcaccaacccgggtacgctggctgacccggaccaggacccgctgccgttcggcggtaacgttctgatccagggtggtgtcgaggttctgttcccgctgccattcgtcaaggatcagcgttccctgcgtacttcggtattctgggatgtgggtaacgtatttgactcgcagtgcaaggacactaccaatgccaacggctcgacgtcgaacaccaagtgcaacgacatcagcctgagcaacatggcaagttccgtgggtgtgggtgtgacctgggtcaccgcactgggtcctctgagcttcgcgttggccatgccgatcaagaaaccggatgacgctgaaactcaagtgttccaattctccctcggccagacgttctaagcgtctgacccaagataacgacaatggattttgtaggagtgcatcgtgcgtaagttgactcaattggttctcctggcctccttgatggtggcaggcccggcatttgccgacatgaaaatcgccgttctgaactatcagatggctttgctggaatctgacgcggccaagaagtacgccgtggatgccgagaagaagttcggtccgcaactgaccaagctgaaaaccctggaaagcagcgccaaaggcattcaggaccgtctgatggctggtggcgacaagatgcagcaaggcgaacgtgagcgtctggagctggagttcaagcaaaaggcccgtgatttccagttccagtccaaagaactgaacgaagccaaggctgttgccgaccgcgaaatgctcaagcaattgaagccgaaactggatagcgcagtggaagaagtcatcaagaaaggtggttttgacctggtgttcgagcgtggcgcagtgatcgatgtcaaacctcagtacgacatcacgcgccaggttatcgagcgcatgaatcagctgaagtaacccatgaccgtgactataaagctcggccagttggccgagttcctcggcgccaccctgcgtggcgacccggagaagcaaattactgggctagccactttgcaagaggctggcccagctcagttgagctttctggcaaatcctcaatatcgcaagtacctggcgggttcgcaggcagcagccctgttgctcaaggaagctgacgccgaaggtttcgccggtaatgcgttggtcgtgcctgatccttatctggcgtacgcgcgtatctcgcacttgttcgaccccaaaccaaaagccgcggcgggtatccacccatcggcggtcattgcggacgatgcagtggttgatccaaccgccagcatcggcccgttcgtggtgatcgaagcaggtgcgcagatcggtgctcaagtgaccttgggcgcacattgcttcatcggtgcgcgcagtgaaattggtgaaggcggctggcttgcgccgcgcgtgaccctgtatcacgacgtgcgcatcggcaagcgtgtggtgatccagtccggtgcggtactcggtggtgaaggcttcggcttcgccaacgaaaaaggcatctggcagaaaatcgcccagattggcggcgtgaccatcggcgacgatgtcgagattggtgtaaataccgcgatcgaccgtggtgcgctcgccgacaccgtaatcggcaatggtgtgaagctcgacaaccagattcagattgcacataacgtccaggtcggtgatcacaccgcgatggccgcgtgtgtcggtatctccggcagcaccaaaatcggcaagcactgcatgctcgccggcggtgttggtctggttggccacattgatatttgtgacaacgttttcctcaccgggatgaccatggtgacccactcgattaccgagccaggcgcctactcttccggtacagccatgcaaccggcggccgaatggcgcaaaagcgcggcccgcatccgtcagctcgatgacatcgcgcgacgtttgaaacagctggaaaagcgcgtaggggaagtgacccctgacggcaatgcttcatcagatggctgataccatttccatatcaagtgtgcacagcctctagactgcctccttgatttgctagaggagtgcgcgtcagtcgcgctcccaatctttacataggcttccccccgaaatgatggacatcaacgagattcgcgaatacctgcctcaccgttacccgttcctgctggtggatcgggtggtggaactggacactgaaggcaagcgcattcgcgcctacaagaatgtcagcatcaatgaaccgttcttcaatggtcacttcccggcgcatccaatcatgccaggcgtactgatcatcgaagcgatggctcaggctgccgggatcctcggttttaaaatgcttgatgtgaagcctgccgacggcacgctttactacttcgtcggttccgacaaactgcgcttccgtcagcctgtgctgccgggcgaccagttgatcctcgaagcccggttcatcagctgcaagcgtcagatctggaagttcgagtgccaggcttcggtcgatggcaagccagtctgctcggctgaaatcatctgtgcggaacgcaagctatgagtttgattgaccctcgcgcaatcatcgatccgtcggccgttctggctgacggcgtcgaggtcggcccgtggtcgatcatcggcgcaggtgtggaaatcggcgaggggaccgtgatcgggccgcatgtaatcctcaaaggcccgacgcgtatcggcaagcacaatcgcatctaccagttttcctcggtaggcgaagacacgcccgatctgaagtacaaaggtgaagagacccgtctggtcatcggtgaccacaacgtcatccgtgaaggcgtgaccattcaccgtggcaccgttcaagaccgatcggaaaccaccctgggcgatcacaacctgatcatggcctatgcccacatcggtcacgacagcgtcatcggcaaccactgcattctggtcaacaacactgcattggctggtcacgtgcacgttgatgactgggcgatcctttccggtttcactctggttcaccagtattgccacatcggcgcccacagcttttccggcatgggcaccgccatcggcaaggatgtgccagcgttcgttaccgtgtttggcaacccggccgaagcgcgcagcatgaacttcgaaggcatgcgtcgccgtggtttcagtgaagacgccatccacaccctgcgtcgcgcctacaaaaccgtgtaccgccaagggctgacggtcgagcaggcactggctgagctggttgagccggcggcacagtttccggaagtcgcgatattccgtgactccatccagtcgtcgactcgcggcatcactcgctgatcatggctaatctgcgtattgcgctggtggcgggtgaagcttccggtgacattctcggcgcgggtctcatgcgggccctcaaggcacagcatccggcggtcgagttcatcggcgtcggcggcccgctgatgcaggctgaaggcctgacctcctactttcccatggagcgtttgtcggtcatgggcctggtcgaagtcctcggacgtctgcgcgagctgctcaagcgccgcaaagacttgatcgccacgctgatcgccgagaaaccggatgtgttcatcggcatcgatgcccccgacttcaacctcaatatcgaactgaagctgcgtcaggccgggatcaagaccgtgcattacgtcagcccgtcggtatgggcgtggcggcagaagcgtgtgctgaagatccgcgaaggctgcgatctgatgctgacgctgctgccgttcgaagcaaaattctacgaagagaagggcgtgccggtgcggttcgttggccacacgctggccgataccattccactggaggccgatcgcgctgcggcgcgcgccgagttgggcctgcccgatgggccgctggtagcgttgatgcccggtagccgtggcggcgaagtgtcccgattgggcgccttgtttctcgacaccgccgaacgtctgcgcgccatgcgcccaggtgtgcgctttgtcattccgtgtgccaacccggagcgtcgcgcgcagcttgaagagttgctcgccggccgcgatctgccggtaaccctgctcgatggcaagtcgcatctggcgctggccgcatgcaacgcggtgttgatcgcctctggcaccgcgaccctcgaagcgctgctgtacaaacggccaatggtcgtggcttaccgcctggcaccgctgacgttctggattctcaagcgcatggtcaagagcccgtacgtgtctttgccgaacctcctcgcccagcgcttgctggtgccagaattgttgcaggatgatgcgacagtcgaagcactggcgcagaccttgtcgccgctgattgagggcggcgaagagcagacccgtggtttcgacgaaatccaccgcacgctgcggctggacgcttccaatcaggcggcggacgccgtccttaacctgatcggtcagacacgatgagcaagacaagcatgcagatgggcctggatttcaccttggtcgccgaagtcgaagaactggtcgccggtgtcgatgaagtcgggcgcggcccgttgtgcggcgccgtggtgacggcagcggtgatcctcgatccgaaccggccgattctcggcctcaacgactcgaagaaactcactgaagccaagcgcgaaaagctctacgacgagatcatcgagaaatccctgagctggtgcatcgcccgcgccgaagtcgaagaaatcgacgagctgaatatcctccacgcgaccatgctggccatgcagcgcgcggtcgccggtctgcacatccagccgaaactggcgatgatcgacggcaaccgttgcccgcaactgccgatgcgcgccgaagccgtggtgcagggcgacggcaaggtgccggccattgctgccgcgtcgattctggccaaggtcagtcgtgatcgtgaaatggccgcgttcgaattgatctacccgggttacggcatcggcggtcataaaggctacccgacgcccattcatctggaagcgttggtgcggctcggcccgacgccgattcaccggcgctcgttcgccccggtgcgtcaggcttatgaagtgctcgaaggcctgacgcaggtttagtcgcaaggctgatgttttgctcgaggcccggtacaatccgggccttgttgtctctatgtaactggacaggatcactatgccggcttcattcgttcatctacgcctgcacactgaatactccctggtcgacgggctggtacggatcaagccgctggtcaaggcgctgaccgccatgaacatgccggcggtcgcggtcaccgaccagaacaacatgtgttctctggtcaaattctataaaaacaccatgggcgccggcatcaagccgatctgcggtgccgacctgtggctgtcgaacaaagacccggacgcaccgctgagccggctcagccttttggtgatgaacgccaagggctaccgcaatcttaccgagttgatctcgcgcggctttatcgaaggtcagcgcaacggcatgatcatcgtcgagcgtgagtgggttgctgaagccaacgaaggtctgatcatgttgtccgccgccaaagaaggcgagatcggcatggccttgatcggtggcaacccggcagaagccgaagccttggcgcgtgaatggatgacggtgttcccggatcgtttctatctggaaatccagcgcaccaatcgtcctaacgatgaagagcaactgcacggtgccgtagcgcttgccgacaaacttggcgcgccgctggtggcgagcaacgatgtgcgcttcatcaagcaggaagacttcgccgcccacgaaacccgcgtctgcatcggtgagggccgcgcccttgacgatccgcggcgttcgaagaattacagcgatcagcaatacctcaaaagcgccgaggaaatgatcgagctgttcagcgatattcccgatgcgattgaaaacaccgtcgagatcgccaagcgctgcaacatcgaagtcaaactgggcacgcacttcctgcccaacttcccgattcccgatggcatgaccatcgacgagtacttccgcaaagtctccttcgacggtctcgaagagcgcttggcggtgctgctgcccaaggacaccaccgaagactacgaagccaagcgccaggtctacgttgatcgcttgaatttcgaactggatatcatcatccagatgggtttccccggttacttcctgatcgttatggactttatccagtgggccaaaagcaacggcgtaccggtaggtccgggccgtggttcgggtgccggctcgctggtggcctacgtgcagaagatcaccgacctcgatccgctggaatacgacctgctgttcgaacgattccttaacccggaacgggtctcgatgcccgacttcgacgtcgacttctgcatggacggtcgtgaccgcgtaattgattacgtggccgagaaatacgggcgcaacgcggtaagccagatcatcaccttcggttccatggccgccaaggctgtggtgcgcgacgtggcgcgggtgcagggcaagtcctacggtttggcggatcgtctgtcgaagatgattccgttcgaagtcggcatgaccttggaaaaagcctacgagcaggaagagatcctgcgtgacttcatcaaggtcgatgaagaggccgcagaaatctgggagatggcgcgcaagctcgaaggcgtggtgcgtaacgtcggtaaacacgccggtggtgtggttatcgcaccgaccaagctgactgacttctcgccgatctattgtgacgaggccggtgacggtctggtaacccagttcgacaaggatgacgttgaggccgcgggtctggtgaagttcgacttccttggtctgcggacgctgacggttatcgactgggcgctgaagaccatcaaccgcgaccgtgccaaggtcgacgagccgccgctggacatcgcgttcatcccgctcgacgacaagccgacgtacacgctgttgcaaaaagctgaaaccacagcggtgttccagcttgaatcgcgcggcatgaaagagctgatcaaaaagctcaagcccgactgcctggaagacttgatcgcactggtggccctgttccgtccgggcccgctgcaatcgggcatggttgacgactttatcaaccgtaagcacggtcgcgccgagctggcgtatccgcactccgactatcaatacgaaggcctcaagccggtattggcgccgacgtacggcatcatcctgtatcaggaacaggtgatgcagattgcccaggtcatggccggttacaccctcggcggtgcggacatgctccgtcgggcgatgggtaagaaaaagcccgaagaaatggccaagcagcgcggcggtttcattgagggttgcaagaccaacaatatcgatgccgacctggccggtaacattttcgacctggtggaaaaattcgccggttacggcttcaacaagtctcactccgccgcttacggcctggtttcgtaccagactgcctggctgaagactcactacccggcaccgttcatggccgcggtactgtcggcggacatgcacaacaccgacaaggtcgtgaccttgatcgaagaaattcgcaccatgaagctgcgtctcgacgcgccggatgtgaatacttcggaattcaagttcacggtgaacgacgaaggccgcatcatttacggtctcggcgcgatcaagggtgtgggcgaggggcccgttgaagcgattactgaggcgcgtgaggacgggccgttcaaggatctgttcgatttctgcgcgcgggtcgacctcaaacgcatcaacaagcgcacactcgacggtttgatccgcagcggtgcgctggatcgtctcggcccgttcttccatgaagagcaaaaggcttatcaggccaacatcgaccgcaaccgcgcggtgctgctggctgcaatggaagaagcgatcaagtccgcagaacagaccgcgcgcacccacgacagtggtcacgccgacctgtttggcgggctgtttgtcgaggaagacgctgacgtttacgcagtgcatcgcaaggccaaggaactgaccctgaaggaacgcctcaagggtgagaaagacaccttgggcctgtacctgaccggtcatccgatcgacgagtacgaaggcgagatccgccgtttcgcccgtcagcgcatcatcgacctgaaaccggcccgggatacccagaccatcgcggggatgatcattgccctgcgggtgatgaagaacaagaagggcgacaagatgggtttcatcaccctcgatgaccgctcggggcgcatcgaggcgtcgctgtttgccgatgcgttccattcggcgcaatcgttgttgcagaccgacgcgatggtggtggtcgaaggcgaggtcagcaacgacgacttctccggtggcctgcgcctgcgggtcaagcgtgtgatgagcatggaagatgcgcgcaccaaccttgccgagagcttgcgcctgaagctgcaaacccaggatctgaaaggcgatcagctacgctggttgggtgatttgctcaagcgtcatcgcggtgcatgcccggtgaccatggaatacaccagcccggatgcgaagaccttgctgcagtttggcgagacctggcggatcgacccggcagatgcgttgattcaagcactgcgtgaccagttcgggcgagacaacgtcttcctccaataccgttgaccggcaagtgccctcatggcgcttgcccgcaacctgaatttttaatctcgacctcagcgcgcctctcccttaaggtagggcgcgaatagacaaccggccggcccaagctcatttgggacacgacccaagacggacgcctatgaacccgaattttctagatttcgaacagccgatcgccgacctgcaagccaagatcgaagagttgcgcttggtcggtaatgacaattcgctgaatatcggcgatgagatctcccgcctgcaggacaagagcaaaacgctgaccgaagacatcttcggcaagctgaccagctggcagatcgcacgcctggcgcgtcacccgaaacgcccgtacaccctcgactacattcagcacatcttcaccgagttcgacgaactgcacggcgatcgtcacttctctgacgacgccgccatcgttggtggtatcgcccgtctggaagaccagccggtgatgatcatcggtcaccagaaaggccgcgaagtgcgcgagaaagtgcgccgcaacttcggcatgccgcgtccggaaggctaccgcaaggcttgccgtctgatggagatggccgagcgtttcaaaatgccgatcctgaccttcatcgacactccgggtgcttaccctggcatcgatgctgaagagcgcaaccagagcgaagcgatcgcctggaacctgcgcgtgatggcgcgtctgaagaccccgatcatcgccaccgttattggtgaaggtggttccggcggtgcactggccatcggcgtctgcgatcaactgaacatgctgcaatactcgacctacgcggtgatctcgccggaaggctgtgcttcgatcctgtggaaaaccgcagaaaaagcaccggatgctgctgaagcgatgggcatcactgctgagcgtctgaaaggcctgggcatcgtcgacaaggtgattggcgaacctctgggcggcgcgcaccgtgatccagccgctgcggctgcgtcgatccgtgccgagctgagctcgcaactggcgatgctgaagaagttcgataacgaagcgctgttgaagcgccgttatgatcgactgatgagctacggcctctaagtcgaacgcagtacccctgtaggagtgagcctgctcgcgatgagggcgtaacattcaaccaatgtgttggctgtcacaccgctatcgcgagcaggctcactcctacatttgtttggggcaaagagttaaatatgggtcagtccatgattgatttgccttcccggctgttgctcaaccttgagccttggcgcaatgccgctcattggcgtatcgccttctccggtggcctcgactccactgtcctgctccatctgcttgcctctctggcgaaatccgaatccctccctccgctaagcgctgtccatatccatcacggccttcaggctgcagctgatgcgtggccgcaacattgccagtccgtttgtgatgcgctgggtgtgcccctgctggtcgagcgggtgaaggtgcaaccgggtgctagcctggagcgggcggctcgggatgcgcggtacgcggtgttcagttctctgacgcaggccaatgatgtgttgctcaccggtcaacatcgcgatgatcaggcggaaacactgatgttccggctattgcgcggcgcgggtgtacgcgggttgtctgcgatgccggcgcagcggtcagtggggcagggcacgctcgttcgtccgttgctggacatctcccgagccgagctggaagcgtacgcacaggctcatcaattgaactggatcgaagacccgtccaaccaggatcggcaattctcgcgcaattacctacgccatcaagtcatgccgctgctgaccgggcgctggccgcaagcgcaggcgagcatggcccgcagtgccgcgcatctgcgtgaagcgcaggggttgctcgatgagctggcgcagatggacctggcgcaggccgcgaccgcccatgatttccaatggctgggattaccgtcgctgaagttgacaccgctgaccgctctgtcggttgcgcgtcaacgaaacgcgatcagccattggctcgagccactgactcgtttgcctgacaccgaccattggtcgggttggagcgatctctgcgaggccgctcatgatgcctcgccaatctggcgactggccgatggcgagctgcaccgcagcgccggtcgggtctggtggctcagcgatgcctggttgtgcgcgccagtgatcggatgtgagtggcagacgccgtcgtcagcgctacgcttggccgataacggacgtgtcatgtttagcgggcaggctcccgccgggccgttgcgcattggctttcgtcaggggggcgaagtgatgcaactggccgatcgaggtcatcgcgacctcaagcgcctgttcaatgagcgcgcggtaccggggttcgtgcgtggcagattgccgctgctgtttcgcggtgacgaattgctcgcggtggcgaacctgccggggcttgatggcgatgggcaaggcggttggaaattgcattggcagccaacagacgaagatcaaggtttgagctgaaaggagcattccggtagactacgctcccttcttgatacaacttctgtggattcgcctgaattgcaggagttgccgattaccaagcagtctttgctgggcgattccaaaaaatgtgtagcgagcaacgtaccggcgtttcatctgccggtctgtcccaacgcggcggtttttttgaaaggtgcactgtgattaatgcaggtgatcgggggcttcggccttccttcgctttccccggcggctcgtaccgctttaacgcagacttctagggtttttcatgacgcgctacatattcgtcacgggcggtgttgtttcttcattggggaaaggcattgcctcggcttcattggcggctatcctggaggcgcgggggcttaaggtcaccatgcttaagctggatccgtacatcaacgttgacccgggcaccatgagcccgttccagcacggtgaagtgttcgtcacccacgacggcgccgagaccgacctggacctgggccactacgagcggttcatccgcacgaccatgacccagaacaacaacttcaccactggccgtgtctacgaacacgtgctgcgcaaagagcgccgtggtgactacctgggtgcaaccatccaggtgattccgcacatcaccgacgaaatcaagcgccgcatcatcaagggtgctggcgatgctgacgtggccatggtcgaaatcggtggcaccgtcggtgacatcgagtcgcaaccgttcctcgaagcgatccgtcaactgcgtttcgaagtcggcgccaagcgcgcgatgctgatgcacctgacgcttgttccgtacatcgccaccgctggcgagaccaagaccaagccaactcagcactcggtaaaagaactgcgttcgatcggtctgcaaccagacgtgctggtgtgccgttccgatcacccgatcgacatctcgtcgcgtcgcaagatcgctcagttcaccaacgttgaagaacgtgcggtgatcgcgctggaagacgccgacaccatctacaagatcccaggcatcctgcactcgcagggtctggacgatttcgtcgttgagcgtttcggtctgcagtgcggtagtgccgatctgtccgagtgggaagcggtggttgacgccaagctgaacccggaacacgaagtgacgattgccatggtcggcaagtacatggaactgctggacgcctacaagtcgctgatcgaagcgatgagtcatgccggcatcagcaaccgcaccaaggtcaacctgcgttacatcgactccgaagacatcgaaaaccaaggcactgcgctgctcgaaggtgtcgacgcgatcctcgtaccgggcggcttcggtctgcgcggcgtggaaggcaagatcactgccgtgcagtacgctcgcgaaaacaaggttccatacctgggtatctgcctgggcatgcaagtggcggtcatcgagttcgctcgtaacgtcatgggctggaaagacgccaactccaccgagttcgaccgcgccagcggtcacccggttgtcggtctgatcaccgagtgggaagacgcgaccggcgccgttgaagtgcgtaccgaagcgtccgacctgggcggcaccatgcgcctcggcgctcaggaatgcctgcttgaagctggctccaaggtgcacgactgttacgccaaggatgtgattgtcgagcgtcaccgtcaccgttacgaagtgaacaacaagctgctgccacaactgatcgaagccggcctgaaaatctccggtcgctcggctgacgcagcgctggttgaagtggtagaagcggccgatcacccatggttcgtcgcttgccagttccaccctgagttcacctcgacaccgcgcgatggccacccgctgttcagcggtttcgtcaaagcagcgttggctcaacaccagaagaaggcgtaaccccgatggcacagaagatcatccgcgtcggcgacatcgagattgccaacgacaaacccatggtgctgttcggcggcatgaacgtgctggaaagccgtgacatggccatgcaggtttgcgaggaatacgtgaaggtcaccgagaaactcggtatcccttatgtgttcaaggccagtttcgacaaggccaaccggtcttctgtgacctcctatcgtggtcctggcctggaagagggcatgcgcatcttccaggacatcaaacaagccttcggcgtaccgatcatcaccgacgtccacgagcctgatcaggccgcggtcgtcgctgaggtctgcgacatcattcaactgccggccttcctgtcgcgccagaccgatctggtcgtcgcgatggccaagaccaatgcagtgatcaacatcaagaaagcccagttcctcgcgcctcaggaaatgaaacacatcctgaacaagtgcgtagaagcgggtaacgatcaactgatcctctgcgagcgtggttcgagcttcggctacaacaacctcgtggtcgacatgctcggcttcggcatcatgaagcagttcgagtacccggtattcttcgacgtgacccacgccctgcaaatgccaggtggtcgtgccgattccgccggcggtcgccgtgcacaggttctggatctggccaaggccggcatgagccagtcgctggcgggtctgttcctcgaagctcacccggatccggacaatgccaaatgcgacggcccttgcgccttgcgtctggacaaactggagccatttctggcccagctcaaagctttggacgaactggtgaagagttttccgacggtagaaaccgcgtaacactcaattctccggtaaagtaccgcacgatttgtcgctcatgccctcgggcatgagcgttatcgtctgcaagtctgcccgctgcacaccccttgccgacggtaaaaagatttcctctagctgcgtcgttttcgtcaactttggagtgtttacaacaatggcaaaaatcgtcgacatcaaaggtcgtgaagttctcgactcccgtggcaatcccaccgtggaagcggacgtgcttctcgacaacggcatcatcggcagcgcgtgcgcgccatccggtgcatccactggctcgcgtgaagcgctcgagctgcgtgatggcgacaagagccgttacctgggcaagggcgtgctcaaagcggtagccaacatcaacggtccgatccgcgatctgctgctgggcaccgacccaagcgaccagaaagccctggatcacgcgatgatcaagctcgacggtaccgaaaacaaagcgaccctgggcgccaacgccatcctcgccgtgtccctggctgcggccaaggctgctgcgcaggatcaggacctgccactgtacgcacacatcgccaacctcaacggcactccgggtgtctactcgatgccggtgccgatgatgaacatcatcaacggtggcgagcacgccgataacaacgtcgacatccaggaattcatggtgcagccggttggcgccaagtctttctcggaaggtctgcgcatgggcaccgagattttccatcacttgaaagctgtgctgaaggcccgtggcctgagcactgccgttggcgacgaaggcggtttcgcaccgaacctggcgtccaacgaagacgcgctgaaagtgatctccgaagctgtcgccaacgccggttacaagctgggcaccgacgtgaccctggcactggactgcgcggcgagcgagttctacgaagacggcaaatacaacctgtccggcgaaggtcaggtgttcaccgctgaaggtttcgccgactacctgaaaggtctgaccgagcgttacccgatcatctcgatcgaagacggcctggacgagtccgactgggctggctggaagatccttaccgacaagatcggcgagaaggttcaactggtgggcgacgatctgttcgtgaccaacaccaagatcctgaaagaaggcatcgataaaaagatcgccaactcgatcctgatcaagttcaaccagatcggcaccctgaccgaaaccctggaagccatccagatggccaaggctgccggttacaccgcagtgatctcgcaccgttccggcgaaaccgaagattcgaccattgccgacctggctgtgggcacctcggctggccagatcaagaccggttcgctgtgccgttccgaccgcgtttccaagtacaaccaactgctgcgtatcgaagagcagttgaatggcaaagccaagtacaacggtcgcagcgagttccgcggctgagtaccaactgataaaaggacaccggattgtgtcgaaaaagtcgtgacagcgatggatttgccactaatctgatgccttaaagcacaagcctggatctttccaggcttcgtgctatcagatgcttcaaagttttggcgtggctgtcttttttcactggatacctgatattcgatgcgcagtccttactggttgtttctcgttttgctcctgctgctggccggtctgcagtaccgcctgtgggtgggcaatggcagtctggcgcaggtcgccgagctgaatcagcagattgctgatcaacacgccgagaacgagggtttgctggagcgcaaccgagtgatggacgctgaagtcagcgagttgaagaaaggtatggagaccgttgaggaacgggctcgtcacgagctgggcatggtcaaggacggcgaaaccctttaccagttggcccaatgatcaattccctgccggccttctgggccgtgattcctgccgcgggcgtcggtgcccgaatggccgcggaccgtcccaagcaatacctgcaactgggcgggcgcacaattctcgaacacagcctcggctgtttcctcgatcacccaagcctcaagggtttggtggtcagtcttgctgttgatgatccttattggccgaatctggcctgcgtcagcgactcgcgtattcagcgcgttgaaggcggggccgagcgttctggctcggtgctcaatgccttgctgcacctgcatgcgcagggtgccgatgatgaagattgggtactggtgcacgatgcggcacgaccgaatctgagtcgcgaagatctcgacaagttactcgatgaactggcggatgatccggtcggcggattgctcgcagtgcctgcgcgcgacaccttgaaacgggtcgacaagcacggtcgggtggtggaaaccgtcgatcgcagtgtgatctggcaggcgtatacaccgcagatgtttcgcctcggtgcgttgcatcgggcgttggcggacagtctggttgcggatgccgtgattactgacgaagcgtcggcgatggagtgggcggggctgaagccgcgactgatcgaagggcgcgcggataacctcaaggttacccggccggaagatctcgaatggttgcgccagcgttgggcgaatcgccgctaaaagatcgcagccttcggcagctcctacatgggattgcatgcctctgtaggagctgccgaaggctgcgatcttttgcttttcaacctcgatactccggccgctcagccaacccctccttcaaaaaatccaccagcttgcgcaccttcggcgacaaatgccgctgctgcggatacagcgcccacaccgccgtattcggcggctgatgcgcctccagcaacgaaatcaacgcgccactgtgcagatgctccaacacgtaataatccggcaactgacacagcccgacgccctgcaacgccgcatccagcaccgcctgcccgctgttgcaacgccagtttccctgcacgcgctgagaaaactcccgcccattctgctcaagctgccagatgtccgagctgccgatcaggcaattatgccggctcagttccgacaaactgtgtgggcggccataccgctcaacgtaggacggtgacgcgcagagaaacatccgacgaggcgccagccgcgtcgcgaccaaccgcgaatcctgcagccgccccaaacgaatcgccaggtccaatccttcatgcaccagatcgagctggcggttgctcaattcgatatcgatgcgcagctgcggataaagccccatgaaacgcgtgaccagcggcacgatgaagcgttcgccgtaagccaccgcgcaggtcatgcgcagcatgcctttcggttcgctggtcagatcgccgactgctcgcaacgcttcttcgcgaccgtcctgcaagcgttggcaatgttgcagaaaggtttgccccgcctcggtcagtgtcacgcgacgggtactgcgataaagcagacgcgtctgaagccgctcctccaatcgtacgatttgtcggctgacatgggaggaagaaaccccaaggcgctcggcagcggcggtgaactggttgcattcggcaacggcgacgaactcgtcgataccttcccagcgattttcggacatcgggattatccctgtatggcaataatgttttgcttttgtcctgattattcatcgtaaggccatgtattacactccttgtctggtttttttattcaatggattcactggagagtcagcatgatcaagtcgcgcgccgccgttgccttcgaggccaaaaagccgctggaaatcgtagaagtcgatgtcgccatgcccaaggccggtgaagtgctgctgcgcgtggtggcttccggggtttgccacactgacgcctacaccctgtccggcgcggatccggaaggcatcttcccgtcgatcctcggtcacgaaggcggcgccatcgttgaagcgatcggcgaaggcgtgacctcggttgccgtcggcgatcacgtgattccgctgtacaccccggaatgcggtcagtgcaaattctgcaagtcgggcaagaccaacctgtgtcaggcgattcgcgccactcagggcaaaggcctgatgccggacggcacttcgcgtttttcctacaaaggcgaaacgattttccactacatgggtacttcgacgttctcggaatacaccgtgttgccggaaatctccgtggccaaaatctccaaggatgcaccgctggaaaaggtctgcctgctcggctgcggcgtcaccaccggtatcggcgccgtgctcaacaccgccaaggtcaaaccgggtgacaccgtggccatcttcggtctgggtggtatcggcctgtcagcggtgatcggcgcagtgaaagccaaggctgcgcgcatcatcgccatcgacatcaatccggccaagttcgagatcgccaaacaactcggcgcaaccgactgcgtgaacccgaaagatttcgatcgtccaatccaggaggtgatcgtcgacatgaccgatggcggcgtcgacttctccttcgagtgcatcggtaatgtgcaactgatgcgtgcagcccttgagtgctgtcataaaggttggggcgaatcggtgatcatcggtgtcgccggtgccggccaggaaatcgctacccgtccgttccagttggtcacgggtcgcgtgtggcgtggttcggcattcggcggtgttcgtggtcgtaccgaattgccaagctacgtcgacatggcccagagcggcgagatcccgctggatacgttcatcacccacaccatgggcctggaagacatcaacaaggcgttcgacctgatgcacgaaggcaaaagcatccgtaccgtcattcatttctgatcaatcgttgggacatggcagcaattcgtgaaggcttgttgccgtgaccgcgtaggagtctttacatgagtctggaaaacatctcctgtcagaagagtttcggcggttggcacaaacgctatcgccatcgctccgacgtgctcggttgcgacatggtgtttgctgtgtacctgccaccgcaggcggagcagggcggaaaactgccggtgctgtactggctgtcgggcctgacctgcaccgatgaaaacttcatgcagaaggctggcgcgatgcgcatggccgccgaactgggtttgatcattgtcgccccggacactagcccgcgtggaccggatgtcccgggtgatccggatggcgcgtgggatttcggtctaggcgccgggttctatctgaatgccacgcaggagccttggtcgcgccactatcggatgcatgactatgtcgtgcaggaattgccttcactggttgaggcgcatttccccgcttcggacaaacgcagcatcagcggccactccatgggcggccacggtgcgttggtctgtgcgttgcgcaatccgggtcgctatcaatcggtgtcggcgttttcgccgatcaacaatcctatggattgcccatgggggcaaaaagccttttcccgtttcctgggcgaagaccgttcgaagtggaaggagtgggatgcctgtgcgctgatcgccgaagcgcacgaaaaactgccgctgctggtcgatcaaggcgatcgcgatgacttcctcgctacccagctcaaacccgaagccttgcaacaagcagcaaaacaagcgggccatccactgacgttgcgcctgcaaccgggctacgaccacagctatttcttcatctcaagcttcatagacgaccacttgcagcatcacgcacgcgccctgcgcggttaatgcaggtagaatcacgccctgacaaaaatcggggcgtttttttatgcgtattggccacggctacgatgtgcaccgtttcgctgaaggcgatttcattactctgggcggcgtgcgcatcgcacacagcttcgggctgctcgctcattccgacggtgacgtcctgctgcacgccttgagcgatgccttgctcggcgctgcggcgctgggtgatatcggcaaacacttcccggacaccgacccgcaattcaagggcgccgacagtcgtgcgctgctgcgtcatgtggtcgcgctgatccatggcaaaggctggaaggtcggcaacgtcgataacaccatcgttgcccaggcgccaaaaatggcgccgcatatcgaatcgatgcgcgcgctgatcgcggcggatcttcaagttgagttggatcaagtgaacgtgaaagctaccaccaccgaaaagcttggctttgtcggtcgcgaagaaggcattgccgtgcactccgttgccttgttgctgcgcgcatgaacgaactgcaattgctcggcccgtgtgcttatggcgaacctctcggcagcgcagtactgaaagctatcgctgaagatttccaggtcgatgaagtgctcgatatcccgttcagcggcgacggcgagcacctgtggatctgggtcgaaaagcgtggcctcaacactgaagaagccgcacggcgtatcgccaaggctgccggcgtgccgctgcgtaccgtcagctatgccggcctcaaggatcgtcaggcgctgacccgccaatggttcagcgtgcaactgccgggcaaggctgatccggacctgtcggcggcggaaaacgatacgctgaagatcctcaagaccactcgccacaaacgcaagctgcaacgcggtgcgcactcggccaacggtttcaccttgcgcctgactcagttcactggcgataaagacgcgattgaacaacgtctgcaactgatcgcccagcaaggcatccccaattatttcggcgcccagcgtttcggccatgacggcggtaacgtcgtcgatgcgcgttcgtgggcagcgcgtaaagacttgccggagcagcgcaacgtgcgttcgcgtctgctgtcgacggcgcgcagctttctcttcaacaaagtgctggcggcgcgtgtggctgatggcacttggcaaaaagctcaggttggcgatctgctggcgttcaccgacagccgcagcttttttccggccggtgaagctgaatgcagtgacccgcgcctggcgattctcgatctgcacccgacaggtccgcagtggggcgaaggtgactcgccgaccgcaggcgctgtccatgaactggagcaggaaattgccgccggtgaagccgagctgcgagattggttgattcacgccggcatgagccacgaacgtcgcatcctgcggctgcccattggcgagttgacgtggcattatccccagcctgacattctgcaactggaattcgtcctcccggccggatgcttcgccaccgtattggtgcgcgagctcgttgatctggtgccggtggggcagacggacagcccatgcgtattctgatttctaacgacgatggggtaaccgcacccggtcttgccgcgctttatgctgcgctggcggattacaccgaatgcgtggttatcgcccctgaacaggacaaaagcggcgccagcagttcgctgacgcttgaccgtccgctgcatccgcaatatctggccaacggcttcatcagcctcaacggcacaccgaccgactgcgtgcacctgggtctgaacggcttgctggagcgcgaggcggacatggtggtttccgggatcaacctcggggccaatctgggtgatgacgtgctgtattccgggacagtcgccgcagcgctcgaagggcgcttcctcgaacgtccgtcatttgccttttcactggtctcgcgtcaggtggataatctgccaacggcggcttactttgcgcgcaaactggtcgaggcccatgccgggcttgatctgccgccgcgcacggtgctaaacgtgaacattcccaatctgccgatcgagcacattcgtggcatccagctgacccgtctcggccatcgtgcccgtgcggcggcgccgatgaaagtagtcgatccacggggcaaggccggctactggattgctgcggccggagatgccgaagacggcgggccgggcaccgactttcatgcggtgatgcagggctatgtgtccatcacgccgttgcagctcgatcgcaccttcaacgatgctttcaggaaccttgacggctggctggagggactgcgctgatggcccgtgagcacgaagatcgattgcgcagcgggatcggcatgacctcccagcgcacccgcgagcgcctgatccagcgtttatatgaagaaggcgtatcaaacgccaaagtgctggaggtcattcgccgcaccccgcgtcacctgttcgtcgatgaagcgctggctcatcgcgcttacgaagacacggcgctgccgatcggcaacaaccagaccatttcccagccttatatggtggcacgcatgagcgagctgctgttggaggcgggaccgctggataaagtgctggagattggcaccggctccgggtatcagaccgctgtattgtcgcaacttgtcgagcgggtgttctcggtggagcgcatcaaggtactgcaggaccgcgccaaggagcgtctggtcgaattgaacctgcgcaatgtggtgtttcgttggggcgatggttgggaaggctggccagcactggcaccgtacaacggcatcatcgtcacggcggtagccaccgatgtaccgcaagcgttgctcgatcagctggcaccgggtgggcgcctggtgattccggtcggcgccggagaagttcagcaactgatgctgatcgtgcgcgaagaaaatggcttttcccgacatgttctaggtgctgttcgcttcgtgcctttgctcaacgggccactggcctgagcatttattggcaggcgctgaattcctttcgttcgcccatgtcttactccggcaacgatggtttaaacgcgcagattgtcagcttgcaaacgtgtgcgcgaagcgatttcgcttcattaaaggtaaagccgattcggcccgttatacttgcgacacctcgtgccgaaatccggcattccaaatttttcagccaccacaaagggagcggcgggtgagtctcacagtcattgcgcagcgtatgggtaacacgagctttcagcgcctggtgactggccttgtcttgagcaccttgctggtgggttgctccagcaccaaatcgaacaatgtgcgcgtggtcgatcgcaacaacgcggtggcgcagcgtcctaccgtaacgactggccagtatgtagtccgtccgggcgatacgatgttttcgatcgcatttcgctacggctgggactacaaagccctcgctgcccggaacaatattcctacgccgtatacgatccatccgggtcagacaattcgcttcgatggccgtaccggttcaacgccgaccgcggtggtgagcagcagcagttcttcgccttcctcgtcgagtaaaaccacggtaatccggcgccaggcaaatggcacgacgaccactacaaccaccggttctacgggggctgcaccgtccgtcggcaacaagtcagcgcctgctccactgcctcccgcaggcccggccccgaccggctggggatggccatctaatggcattctgattggaaaattctcttcaaacggtagtttgaataaaggaattgatatcgccggagatttgggacagcctgttttagctgcgtctgatgggacggtggtttacgccgggagtggcttaaggggctacggcgaattagtcatcatcaaacacagcgaaacctacgtcagtgcctacggccataaccgcaggcttttggttcgggagggacagcaggtcaaggtcggacagacaattgccgaaatggggtcaacgggtacagaccgggtgaaactgcattttgagattcgccgccaaggtaaacctgtggatccgctgcagttcctgccaagacgttgatttgtaagccagcctgttccgtcgcgtagaggggacaggctccagcgctgccaaggataaaggcgtcgcttgagcttggggtcgaactcaccaaaggactataacaatggctctcagtaaagaagtgccggagtttgacatcgacgatgaggttctccttatggaggccggcatcgattcggattcttcgatgtcgaatgatgaaggggctgctccaccttccgttcgttccaaatccaaacaatctgcgtcacttaaacaacacaagtacatcgattacacgcgggcacttgatgccacgcagttgtatctcaacgaaatcggcttttccccactgctctccccggaggaagaagttcattttgcgcgcttgtcgcaaagtggcgatcccgccgggcgcaagcgcatgattgaaagtaacctgcggttggtggtgaaaatcgcccggcgctacgtcaatcggggtctgtcgctgctggatctgatcgaagagggcaaccttggattgatccgcgcagtggaaaagttcgatcccgagcgcggcttccgcttctcgacctacgcgacctggtggattcgtcagaccatcgagcgcgcgatcatgaatcagacccggaccatccggttgccgatccatgtggtcaaggagctcaacgtgtacctgcgggctgcacgggagctgacgcaaaagctcgaccacgaaccttcacccgaagaaatcgccaacctgctggaaaaaccggtgggtgaggtcaagcgcatgctgggcctgaacgaacgggtttcttcggtcgacgtctcgctgggtccggattcggataaaaccctgctggacaccctcaccgatgatcgtccgaccgatccctgcgagctgctgcaggatgacgacctgtcgcagagcatcgatcaatggctgtcggagctgaccgacaagcagcgcgaggtggttattcgccgctttggcctgcgcggccacgagagcagcacgctggaagatgtaggcctggagatcggcctgacccgggagcgggtgcggcagatccaggtggagggcctcaagcgccttcgcgagatcctcgagaagaatggcctgtcgagcgagtcgctgttccagtaagcgcctcggacgaccacccgcaaaaagccccgactggttcggggctttttgttgcctgctgcttttgatgtcggtgctgttgcttgtgcaggagctgccgaaggctgcgatcttttgatcctggttcaagatcaaaagatcgcagccttcggcagctcctacacgggagggtttgtagtcttgtgctgtaagccttggcttactcttccgtaggtgttcgttatttttacacttcggtagacgactactcagtcagtcgactagaaataactgactgataaataagcttaattttaaatatgaagcggttatgacaaacgatttcggcgccaatggtcgattgctcccgccgcagaactctctagtatctgaattgtgtcgacggacagacacgcccttcaaggaagaggggaacggacatcgcaggacgcgattcatcaggacgatgaaaaggaatacagggaatagggaaaaaatgtgggcgggtcataccgccccttttttttgcccgtagaaaagtcagcatgcgcagcttggcgtctctgtcggaggcattgcgcgacaaaaaaaggcccctaagggcctttttgtcgaacgcgagacagatcagcgttcgaggtctttgatcttgcctttgacgccatcccactcttcggcatccggcagcgattctttcttctcggtgatgtttggccagatttctgcgagatcaacgttcagttgaatgaattcctgcatgtcctccgggacttcgtcctcggagaaaattgccacagcggggcattccggttcgcacagggcgcagtcgatgcactcatccgggtgaatcaccaggaaattcgggccttcgtaaaagcagtccaccggacagacttctacgcagtcggtgtacttgcacttgatgcagttgtcggtgacgacgaaggtcatttctaattttctcctcaggcggcggcagcgttgccccttcacggttggggtcgccaggttcgggagcgatacctgctggccaggctattagccagcagcatcccaaaccgcgcgagattctaacagcttgaagcggtttgcgttatatccgcttcttcagtgcttatatccggttcttcagtgcatagagcatttcgagcgcacggcgtggcgtcaggtcatccagatcaagtttagccagttcatcgagtactggatgcggcaggctggcgaacatgtcgctttgttgtggcgttgccggtttgcccttggcgaccggtttcggtgcttcatgcggcaaagcggtttcttccagtcggctcaggtgctcgcgggcacgtacgatcacttcgctcggcacaccggccaattgcgccactgccagaccgtagctctggctggcagggccgggcagcacgtggtgcaggaagacgatgcgttcattgtgctcggtggcgttaaggtggacgttggccaccaatggctcggcttccggcaacacggtcagttcgaagtagtgcgtagcgaacagcgtataggcacgcaggtgtgccaggcgctccgccgcagcccatgccagcgacagaccgtcgaaggtgctggtgccgcgaccgacttcgtccatcagcaccaggctgcgttcggtagcgttgtgcagaatgttggcggtttcactcatttcgaccatgaaggtcgaacgcccgcccgcgaggtcatcgctggaaccgattcgggtgaagatgcgatccaccagcgacagttcgcaactggccgccggtacgaagctgccgatatgcgccagcagcacgatcaaagcggtttgccgcatgtaggtggatttaccacccatattcgggccggtgatcaccagcatgcgcgtgttgtcatcgaggctcaggtcgttggccacgaacggcgttgtcagcacttgctcgaccaccgggtgacgaccctgggagatgcgcatgcacggctcgctgacgaagcgcgggcagttcaaatcaaggttgagcgcgcgctcggcaaggttgctcagcacgtccagttcggccagcgcgccagcggtatcctgcaacggtggcaactggctgatcaggtcctccagcagcgcttcgtaaagcatcttttcgcgggcgagggcgcggctcttggccgacagcgccttgtcttcgaattccttcagctcaggcgtgatgaagcgttccgcacctttcagtgtctggcgacggatgtaatccgctggcgccgactcggcctgcttgctcggcaattcgatgaagtagccgtgaatgcggttgtagccgactttcagatggctcagaccggtgcgggctttctcacgggcttccagatcgatgaggaactggccggcgttttcgctcagcgactgcagttcgtcgagttcgctgtcatagccggttttcaacacgccgccgtcacggatcaccgccggcggattgtcgatgatggctttatccagcaacgccgccagttccgggtaggtgctggtgatggtcgccagaccttgcaggtgcggcgcttccagatcggtcatcgccacttgcagttcaggcagtgcgccaagggcgtcgcgcagccgggcaaggtcacgaggccgcgcgttgcgcaggccgatccgcgcgagaattcgctcgatgtcgccgatttccttgagctgtggttgcagcttttcgaaacgataacgatcgagcaggcaagtgatcgaggtctggcgcgccagcaataccgtcagatcgcgcaacgggcgattcagccagcgggtcagcaaacggctgcccatggcggtctggcaacgatcgaccaccgattgcagggtattgtcgcggccaccggcgaggttggtgtcgagttcaagattgcggcggctcgcaccgtccagtaccacggtgtcatccaggcgttcgtggcgcaggctgcgcagatggggcagggcggtgcgctgggtttccttggcgtaggccaacaggcaaccagcggcgccgatggccaaggtcaggttctcgcagccaaagcccttcaggtcttgggtggagaactgctggcaaaggcttttcaacgccgaatcacgctcgaaatcccacggcgcacgacgactgacgccacggcgtttttccgccggcaggtcccttggccagtcatccgggatcagcaactccaccggattgatccgctccagttccgccagcagattctcccagcctttgatttccgacacgctgaaactgccgctggtgatgtccagcacggccaggccgaacagacgctcgtcacccagcaacgcagcgatcagattgtcgcggcgctcatcgagcaacgcctcatcactgaccgtacccggcgtgaggatgcgcactacctgacgctccaccgggcctttgctggttgccgggtcgccgacctgctcgcagatcaccaccgactcgccaagcttgaccagtttggccagataaccttccgccgcgtgataaggaatcccgcacatcggaatcgcctgtcccgccgactgcccgcgtgccgtcaacgtgatgtcgagcaacttggcggccttcttcgcgtcttcgtagaagatctcgtagaagtcgcccatgcggtagaacatcagctgatccgggtgctgattcttcaggcgccagtactgctgcatcatcggagtgtgggaggacaggtctgaaatagctttattcatcaggggtttagctttaccggaaaaagtgacaaggcaaaaacggggtcgtttgcatctacgaaatggcgagtgtttgccagcgatgcggcccgtgggttgattcagtggggctgagtatgaagtttttttgaggtggatgcagcaacgcgcggccgcttgggttggcattgtgtcctatagtgccgaaaagctatcgaatgatcggaattcgaggattgcagatcagttgaggatgcagcttggaacaatcagagggcatcggctcacaagcgtcagcgagcgattgttactacgatgcagaaaaaatgaccctcagccgggcgcggcaggcagcggtgctgggcagcaatgaaagcgacctgctgttggcgctgatagccggcgtgaccgataaggaacagctcatctccagggtctggggggagcgggggctggtgatttccgacagcagttattacaaaacgctgcacatgctccgcgcgcatttcgctgacgtcgggttacctcgggacagtcttaagaccttgcctcgccgtggcgtggtgctgttgtgtgaaattcggttggttagcgcgcagactcaagcctctgagtcgccgccagcgctggtaaatgatgctgaacccttcatcgtctacgctcccacggtgaaaaagccattcagtcgttactggcgcttccttttgccgacaatcctggtgccagcgattgctcttccggtcttttacgcttatctggtggttaaaaaacctgctgatctggaggagtggaaactcatctggcaagaaggtgaagcgaaattgtatgtagaagaaagtgaaagaatgtccaaagaggatattgtcaaagcgctcagcgagttcgaaccacccattgtattgtccgatattaactactacgtgcgaaaaccgctctcccaattactggtcaagtgcatcaagccggaaagcaagggggaggccatatgcgtgaactaccaactcgttggaaaaaaataattacagtgattgctgccttgtcggtatttatctttggtactctggttgtaaagcatttttatttgctcagtcgcgatattccaggcgcaccttgttttgcatccattgattttgtccatactcatgatcacaaagttcgttggcatggcgttggggaaatgacgatcgacccaagggaaggcgctctctatgtgcactacgtcgttaaaacccctgaaggcaaagtctatacttatgatcgtaagttcgaaattgtactaacgcatctggatacttccaggtttctgttcaagacccgttcgattgtaaagtttgatgcggacaccgccggcgatgagcttccgtttatggaaagaggttttcaaggtggtatggtgacattcaattacttctccgataccgagtactattacaacattaataacctgatcaacggcgtatgccacgtccctcgctagggagaatccccggggtgcgaggcctctgggcgattaagtaagactgagtaagacgccagtaaggcctcagcgctcctgcgttgttaatgtgattcgagtcaggccaacagcccctgcgactgccggagagtcagcgcagtttggctgttagttgccttgaataacatgacgatgtttaggctgttgaggaacgttatagatgctctggttttgcctgcgcagttctcatggaaccaagtctcccgcctggaagcgatcaattgcaattaaccgggaaggtattgtgtttgtgccagcggtgattgctggaaaagaaaaggatgtgagtcttttcacattgtgtgatcgcactcctgttctgctgtgtttcgatcatgtttacgtaccagtggcgtggatggtcaagcattttccaacgtgtagagctcgctgtcgcgacatgatgatggcggcactttctggcgtacaagaaacgttaggttgccgtaatgcatggtctcgggtgagcaacttccgtggccgtgctggagaaaaaaattatctgggatttgtctcgtgagaccgaatcttttttgcaatctgtctctgctgattgttagcgttttaatcatcgatagtgcatgggctggtgtgcgagaaagttgcgcgcagcggcgtaccgaacttttgttgcagattgagcgcgctgaggcggcggacaatgtttatcgaaagtccggtctagagcaggcacttgccaatgtcgagcgccattgccaagaaccctccgcgcaagatgaccgttcaagcgccatccaaaaggccgcagccgaagtgcgacgcagacagaactttctggaggccgcgcgtcagtacggtgatgtgaaagtcatcaagaaacaggaagccaggctcgaacgggctcagacaaaactgcaaaggcttatggatgagtaaagagtcaatcaccgccaaagattcgcagggggtgctctttcttcaaccctgcaattcaacgtgttcatcagtgacgccgggaaatcgaatatgaaaaacatccttattttttcttcagtctttacttctgctgtgctgatctctggctgcaccgccaccgactgggtgcacgctgccgggggaatcatgggcgccaaggacgattacgacaggaaggccagaaccgatcgacttaaaaaagccaatgctgccgcacgtcgcgtcaaaggctgaccacacgttggagctgggccgttattcaatgcagaatgatggcccggcaatatcgttttgcagctgaattcatatttatgcgttaattatgcaaatcagcatttgtcttaacgaataacttcaagcactatgcgcgttatgcaaaaacgcaacgtagcctccgtcttaagagcactgctcgaccagcacgggatctcccccacggagctccaccgtcgcaccggcgtgcctcaatcaactctctcgcgaattctcagcgggaagatcgtcgatccctcggataaacacatctcgaagatcgccgagtacttcgccgtgagcaccgatcaattgcgcgggcgcgcggatgtcacgccgtcggccggtgccgtgcgtgatgacgtgcacgcggagctcaaggacataatgctgtgggacgacgatacgcctgtcgatgatgacgaggtgtcggtgccgttccttcgcgaggttgaattggcagcaggatcaggaagattcgtcatcgaagagagcgagcgctctagcctgcgcttcggcaagcgcagtctgcgccacaatggtgtgcagttcgaccaggccaaatgcgtgaccgtgcgtggcaacagcatgttgcccgtgctgcgcgacggcgccactgtcggtgtgaatgccggcaagtgcggcatcggcgacatcattgatggcgacttgtacgcgatcaatcacaacggccagctgcgcgtaaagcagctttaccgcttgcctaccggcattcgtctgcgcagcttcaatcgcgatgagcatccggacgaggactacagcttccaggaaatccaggaagagcaaatcgtcatccttggtcacgtcttctggtggggcatgtacgcccgctgatctgatcgacttgaaatgaaacccgccctcccggcgggttttttttcgcctgcagaaaaccctcaaagcctttctggacggggcctccatgcgcccgtgcatttccagcgcataaataaatgcatttatgcattgactgtatatgcatccatgcatattcttgccaccaagccgctcgacaaagcggctggcaagacaagctctttagttccacaagaacaggcagcgatgaaccggcctcaacggttcagagggttggcaactgacccgggtgtgcagcgtaaagcaccagaagcagttatccggcgggcagggaccgcggtcggaaaaacaatttgaatggactcgtaccgcgccagtagcgccgaaaagtcagcttccttcttgaacacaggatttgaaggaaggcgaaggagcgcattactgaaaagcccggtgcatcgtcgccgggctttttggaatgcctgccctccagcttgcagatcgaacctgtctgcagattcatcgcttgacccgcccacaacggaagttgccggcagacatcaaaaaggcattgcagatgttgaaagattgcagatgtggaaagtgcaaaagactgctcgcccgaatgggtgagtacacagagttccagatcaaatgttcccgatgtggaacattgaatcatgtgagggccaggagccccgaacgatcgcctgtgagcgacttgagtgctgcatcgccagcacaccctgatcaatccactcataggtagagaaatgaacactttgaagaaatacgcagcaccgtttctgatcgctgctgcactgctgggtaatggcggtagcgcggttgccgctaacctgttggtcaacggcagctttgagcagcccggctgcagcggcagctgcattctggacaccccggcgaaagccaatttcatcaccggttggacgacgtttctgtccggtgccgaatacttcaacatgccggcttcgatcggtggttccgcggcagcggacggcgtggtgatcgttgacctggccaactacgtttacggcaatgggggggggattcagcagaacttcgccaccaccgtgggcgccaagtaccgattgaccttcagcgcgggtaactcgcgttacgccagccgctccggtgatggtctcattcaagtgaaagtggccggccagaccgccacctttaacacaccgtccgccaaaggcgtcgcggttgagtggaacaccatcacttacgaattcactgcaatcactccacagacgacgttggcgtttttcaacgagcagaatccgtatgccaactttgcctttatcgacaacgtcattgttgagcgtctgtaactccgaccgccgtggatccacggcgttttatccaagcgtgaaaggcgacaccgttacggtgtcgcatcctcacaacccccttattcatcaacgctctcaggaggcgtgacatgacaaccgagcaacaagcattggccgatatgccaatctggctggtcatcctcctcgccgtagtgggcggagtgtccggcgaaatgtggcgcgccgacaaggagggcgcacgtggctggccgctgctgcgccgtctggccttgcgctccggcgcctgcatgatctgcggtgtgtcggcgatcatgctgctgtatgccgctggcatgtcgatctgggcggctggcgcgtttggttgcctgacagcgatggctggcgccgacgtcgccatcggcttgtacgagcgctgggccgcgaagcgcatcggcgtctgcgaagtcccgcctcgcgaccaaccttaaccgtattaattctccgtgccgccattttggcggcagggctgcgcgtggacgctcgaaaaggaggtcatgtatgcccacaccgatccagcagccgtcgcaactgttcacagccatcgcgacgacactgcgcaacactgccggtctcaacctcaatgtaggcaatcacgatgatttcactgccgcgggcgatcaagcctgggtgttgatcgacttcgatcgcaatgcaagcggagtgcgcgccgctgatgggcgcatagctcatgtcatgacggtgtccctgcaagtcatcccggcccttgccgccagcgcattcgcggcgtgcgatctgatcgctgtgttgaaaaacctgatcaccgacaacgcttggaacttgcccggcgaccagtgcgatctgccaatgaacatcgatggcttgccgtcattgctcatccgcgccgaccagcaatacaaggcctggaccctgacgttcaaccagaccctctacctcggcccgaccttgctcgatgatccgctgggtacgccgaaattcgctcgcacctgggaagtcagcaacatcgacgaccccgaccagtacaccgcgctggagacctgaccaatgttcgacgcattactgcgcatgcaactgggtccgatcatcgagcgcctggccgaaatggaagccgaaatcgacgacctgcaccgccgcgccgaaagcttctgccgcatcggcatttgccagacagtcgacgctgcgagcaacacctgtcaggtcagtcacggtggcttgctcacgccagccatcaagtttttcaatccgagtgccggtgcgcagagtgagtcgcggattccgaccgtgggtgagcagtgtctgttgttcaactacggcagcggcgaaagcggcgcacagagcgtggcgttgttcggcttgaacagcgaccgctttccgccagcctccaccgtgccgacgctgacccgtcgagtacatcaggacggcagcgaaagcggttacgacgacgcctcgcacactctgcactggcaaaacggcccggcagccttcagcggttcacgcgattcgctggagctgagcatcggcctggcccggttagcgatgacaccccaactgatcaccctgcaactcggtgccgtcggcctgactatcgacgcctcgggcgtgcacttcagcggcccattggtcgatcaccagggccgcgttatcagcccctgattcaagagcctcccatgatcggaatcgatagagacagcggggccacggtcgacgactggctgcagtttgtgcagcgcgcgacccgggccctgactacgccgctgggcacccggcaaaaacggcccctgtatggctcgttgatcccctcgctgctggggcagaacctcggtgacgacgttctgcttctggcccagagccacgcggcgcaagcgttctataacgcgcagaacgggatcagcgattttcagccgcaagtgatcgtcgccagtcgtcagggcgccggcctgttattgcgtttcgccggcacctggaaaaaccgtcaacaaaccttcgaggtcgtgacatgagcatgttgatccccggtcagaatcaattggccgaacccgcgctgatcaccgttgaagccttcgaagatctgctctccgagttcaaggctttcgtcatcgaatacgtcggagcgcgctcgccagaaagtgccgcgaaactcaagaccagtctggaaaacgagagcgaactgctgacgcttgcgcttgaagctttctgtgtccggctgcaaacccacgagcgcaaatacaacgctcgcatcaaacagatgctggcgtggtgggcgacggggagcaacctcgatgcgcggctggcggacatgggccttgagcggcagttgctcgatcccggcgatccggcggcattcccgccggtgccggcgatttatgaaagcgacgacgacgctcgcttgcgttattacctggcgccccatgcgccggcagcaggttcgcggatgcagtatcgccgcgaagttttcaccctcggcgagcgtccgacggtgcaggtcgaatccaccgaggcaggtgtggtgaatgtcacttacaccttcaacccggacggcctcgctgcgcaggtcaaggatggcaacgggcggcgcacggcaccgggcgaagtgcaggtcactgtgctgtcccgcgacggtgatggcacgccttccacgacattacttgacggtgttcgtcagcacttcgcgcgaccggatgtacgaccggaaacggacctcgtcaccgtcaaggctgctgacattcagcgctacaagattcgcgttgtcgcgaagatcaattccggccccgattcgggcctgaccaaagtcgccgcgcaagcgcagttgcaggcttacgccgacagttgccatcgcctcgaaggccgggtcgatccgagctggatcgactacacgctgcacagcgccggtgccgtgcaactgcagattcttgaaccgctggcgccgatcgtgaccacggcgtttcaagcgccgtattgcacggcggtcgaggtcgaggtgctgacgctatgagtgataaaacccagcgcccgacgctgctcccggcgaatagttcggcacttgaacgaggtctggatctgggctttggtgcattgctcgatcgcatcgcgccaccgtttcctgaactgatgaaccccgcagaaaccccggtcgcctttctgccgtatctggcagctgatcgcggtgtggctgaatggagcaccgctgcgccggaggcggaaaagcgcctgactgtcgaactcgcctggcccaccgcgcgccaggccggcactcgcaaggcactggaaaacgccgccaagggtttgcagttaagacccgagattcgcgcctggtacgaacagacgccgcccggcgcgccttacagtttttctgtacgagccttcagcgaacaaccctacagcgaagaaatcgacgcccgtctcgatcgacgtctggctgatgccaagagcgagcgcgatgtgctgacggtctccgttggcttgagcgctttcggcaatcacgtcatcggcgccgcgacgttctgcggcgaactgaccacggtttatccggtgttcatcgaagggctcgaaacctcgggagaggcgttcgtggctgccggtatgtacaccgtcgaaacatccactatttatcctcagggggcctgaatggctgactattacaccctgctcaccaacgcagggattgcctacgaaacggcgtgcaaggccgcgggcacgccgatcaagttgacgcagatttccgtcggcgacggcggcggctcggtctacaacccggccgcgaccgccaccgcgttgaaacgcgaagtctggcgcgggccgctcaatgcgctgttccaggacgagaagaatccgagctggctgctcgccgaagtgaccattccgccggatgtgggtggctggtatgtgcgtgaagcggggttgtggactgataccggcattctttacgccatcgtcaaatatccggagtcgttcaaaccggttctggccacatccggttcgggcaaagagttctacattcgttcgattttcgagaccagtaatgcgtcgctggtgacgttgttgattgatgacaccgtggttaaggccacgcgtgcctgggtcatgagttatctcgccgaagaactcggcaagctggatggtaagcagtcggtgcgtgttgcggcatccagcaacatcgtgctgagcggtgcgcagcaaattgacggtgtcgcagtgattgctggcgaccgcgtgcttgttgcgaatcagacgctggccaaggacaacggcttgtggattgttgccaatggtgactgggtgcgggcgacggatgccaacagcagcgccaaggtgacgccgggtctgacggtcatggtcgaggagggcacggcgaatggagattcgttgtggcatctgaccaccaatgcgccgattacgcttggcacgaccgcactgatgttcaagatgctcgcggggcgaaccgggattgctgccgggacgtacaagagtttgaccgttgatgaatatggtcgcgcgacggcaggtgcgaaccctgagacgctggccgggtttggcatcaaggattcgtacaccaagggtgaagttgaggcgttgattgccaaggcgtcggcgttgccggtgggctcgattgtcgcgttcccggttgatgcgccaccaccgggttttcttgagctggataacagcgtcaaaagcagtgcgacttacccggacttgagcgcctatctaggtagcaagttcaacaaaggtgatgagggtgtcgggaacttccggttgcctgaggcgcgtggggaattcttgcgcggttgggatcatgggcgtggcgtggatgctgggcgtggtctcggcagttggcaggccgacgacaacaagtcgcatgcccatacggtcacccgcatgcaggcgttcgccaatgccaccggcagcaatccgagtgccgtagtcgtagacaacggcaatacggccgtaatgaccaatttcgcagcaggcttcaatagttctggtggcgcggaggcacgacctcgcaacatcgccgtcatgtggtgcataaaagcctggaacgccccggtcaatcagggaaccatcgatgtcgccgcgctggccaaggaagtagaacggctcaaatccgccgttccgattggcgctgttctcgcattcccgacgggtattgtcgctcccggttatctggagctggatggcagtgtgcaaagcattacgacttatccggatctggccgcctatctcggcactgtctataacaaaggcaatgaaggcgcgggtaacttccgattgccggaatcgcgcggtgagttcctgcgcggctgggatcatgggcgcggtgtggacgcggggcgaactgtcggtagtgtccaagccgaatcgttcaaagctcacaaccaccgttattttgatgagaccggtgcaacacttgatccggctggcgcgtggcaggcgggtaaagtcaatggcgcggctgcagtcatatctacaggcgcttttctttcggccgtagataccggggtcacgatgcaaacagtgactgccgtcacgactgtggataccggtggggcggaaactcgtcctcgtaacgtcgccgtcatgtggtgcatcaaagcctggaacgcgccggtcaatcagggaagccttgatatcgctgcgctagccgttctggggcaacaagcgaccgaaatcaaacaaggcacggctaaagtttcaacccaagagcagaccgactctggggctgacgacagcacaatcgtaacgcctaaaaaactgcgctggggttttcaaatcctcaaagctatcaacggttacatcattttcccgtcgtggctcggtggcttgattgttcagtggggcagggcctccggaaatggcggtacggatattgccactgcctttccgatccctttcccaaatgccatgtacagcttgaatgccaccttgaactacacgcctgggtcaccagtgaacgggtatgtggacgtgggagtatcaaatctcactgcattctacggaaagcacacatttcctggggtcaccgtctttcattgggtcgcggtgggcagttaaggagtaatcatgaaatacgcactattcgacgaacattcgaaattacagacctgtctgattgaaggggttcatcagatccccgcgtcagccgtcaaaatcgaccaggacctgtttgtcaggttgacgcaagaaaccgatggtatctggcgaaaagtgggcaacgagattatcaaagagccgtttccgcaagtggctcctgactatgcgcggtcagtcgctgccgagcgttatgagcgcgaagattctgccgtgtctgtggacggtctatcgattgcgacctcgcgcgaaagcgcggggctgatttacggcgccggactttcggcgatgcttgatcctgactatcgctgcaatttcaaaacactcgatggcttcgtagaaattggagcgcagcagattctcgctattgccaaagccgtcagggcgcacgttcaggcttgcttcgaccgtgaatttcagctgcttcaagctgtcgaggcaggcacttatgtggatgcaatgctgaaagaaggctggcctgattccgtgccggttacaccaatctctgcgcttcaataaacgtccgcaccctagggcgttttcttgtccgcccaacaatattcaacacccgccaaagcccctccccaagaggggctttcccgtttatggagaaacgaaaaatggcaacccgccaaacctacaccgtgctcgtcccattccccactggtggtgggcactggtcgagcgtcggtcaagaccttgatctgctcgacgtcgaggccagtgcgctgcacttcgccggtcgactggaactgaaaaccccctccacccaggccaaaaaggccgctgccaagaaggctgactgaacatggctgaggttctgaacttcgagcacaacggcattaccgtcaatgccaccgaatcccccgaggccatgggtggcctgggtgacaacgtcatcggtctggtcggcaccgcgccgaacgccgatccgctgattccgcgtaacgcaccgttccgcatcaacagcttcaccacccacgcgctgctcgatccgaccggttcggaagagggcacgctgtaccacgccgtctaccagatcctcaaagtggtcaaggtgccggtctacgtggtcatcgtcgaagcgggcgcgaccccggccgacacggtaaatgcagtgatcggcggcgtcgagccattgactggccgcaagctcggtctggccgcgctgggcagtgtcccggaagacctgaccatcatcggtgcgccgggcttcaccggcaccaaagcggtggccagcgagttcgcctcgttcggcaagcgcatcaaggcccgtgtagtgctggacggcaaggacgcctcggtcgccgatcaagtgctgtacagccaggaattgggcggcgccgatcttggtttcgaccgttgcctggtggtgcacaacatgcctgcggtgtactcgaaagcggcgaagaaaaacgttttcctgtcgccttccagtctggcgattgccgcactggccaaggtcaagcagtgggagagcccgggcaatcaggtgacctacgccgaagacgtgtcgcgggtcgttgaatacaacatcctcgacacctccaccgaaggcgatctgctcaaccgctacggcgtcagctactacgcccgcaccgtgctcggcggcttctcgctgctgggtaaccgctcgatcaccggcaagttcatcagctacgtcggtctggaagatgcgatcagccgcaagctggtcaaggccggccagaaagccatggccaagaacctcaccaaatccttcatggatcaagaggtcaagcgcatcaacgactggctgcaaaccctggtcgccgacgaaaccattcctggcggcagcgtttatctgcacccggaactcaacagcgtcgagaagtacaagaacggcacctggtacgtggtcatcgactacggccgctacgcgccgaacgaacacatggtttatcaactcaacgcccgcgatgaaatcatcgagcagttcctggaggacgttctctaatgtttaccaaccgcgtaagacaggccatcgcggccaccctgcaaggcctgccgctgtcggcgaccgttgaagaattcaccccgccgaagatcgagttcgacgtcgaagaaatgcgtggcggccgcttcatcgtcgaggaaatggccaagggcggcaaagcgctcaacgccaagctgaccctgcaaggcctcggcgccgaagtcatgctcgcactcggcgtgaagctgggcgacgacatcctgctgaacgtgcgtgaagccggtcaggatcaggacggcaacacctggttcacctaccacaccgtcggcggcaagctgaaatccctggaagagactgcggtgaagatgggtgaaaaacccaagaccaatctcgagctgtcctgccgcacctacaaccgcctggaaaacggcgtaccggtgatcgacatcgacgtgcgcacccagaagttcgtgctcaacggcgtcgacatcctcggtgatgcgcggcgtgcggtgctgatgccgtaaatcacggcacaacacaaaaccctgtaggagtgagcctgctcgcgatgaggtcagtacatgcaacatcaatgtgcctgaaagaccgctatcgcgagcaggctcactcctacaagggaatagcgatactccctaaaaaagaatcaccaaggaattcatacatgtcgtggatgccaccccagcatgacctgttgtcgccgatcaccggtgacgacggttcgcagatcgagacaatccagctcaagccgctgttctacgccgcgcaaaaagaagcgctggaacgcgccggcgatgacgaagacgatcaattcttcgaactggcgctgctcgccactggcctgtcggtcaaggaactcgaccagctcaagcgcccggactacgtgagcatcgcccagtacgtgcacgagatgtcgacccaaacggcgtcgtactttctcggccaggtcgatgacgcggaaaaaaccgccgatcccgatcaggtgcaactgctgcaaccgctcgccgtgaccggccgcaccgtgacgtggctgagcctggaaatgcctgtgctgcgcgccaccaaagtgatgaaaaaactgaaaacggccaaggagcgcgccgagttcatcaccgcccattgcaccggcctgatgatccccgatctggcccagttgactgtccctgactggacgcaattgcaggtgcgcatcgacgattttttaaaccagccggcggcctactttcggaacgcgacatcgaagtaatcctcgatatcgtcccgctcatttacccggtaagtgaggcggagattctggaatgggacgccgaaaaggcgttgcgccgctacgacatagcgatcactcgccttggcgtgaaacaggagtagagcggcaatggcagacacatcgttttcgctgatgtacgccgcgcaaaccgcaggcgcgggttccggcttgtcggcaggaggatcggccacagacagcctggtcaaaccactgtccgaactgaaagaggcgttgcttacggccagtctggacatccgcagtctggtgcgtgaacagatcaaactcggcgctgttgtcctggggctgaacacggccctggcatcattcaaggtgccagtggtaactgccgcgccggcggcaggcggcgaaagcaagtcaaagctcaaggctgagattgaacaacgctcgcctccggcctacctgcaatcggacatggccctggaaaccgccatggcccagctcaggcaggttcaaggcctgagtggcgacctcggcacgctgtcgaaagccaacctcaaactggccaccgacaaacgggtttccggcagtggggcgacggtcgtggatctggtgcaggtcgaagtcgcggctggcagatccgggattggtgcgggtctcaagggcgccgacaaggaacaagtgctgctggactttgccctggatgcagcggtcaatgcgtcggcgttcggcatcagcctgaagtcggccggtgaaatgctgtcggcctggcaagtctcgatgagactggatcagactcaaggtcagctgctggctgatgcgactcagcatctgggcaacagcggactgaatacgacggctgccgacatcggctcggtcgtgcagcaatccggcgagtcggccgttgcagcggggatcctgcccgagcagttggcggcgctgtcagccgcgttgctcaatgctgacgtcgacaaagccggtgccggggcgtcggtgaaaagcatcagcgcagcgttggccaaaggcccccaaggctcggcggccgagcagtcggcgtggaaggcgttggggcttgatcccggcaagttgaccgaaaacgtaccggacaaccttgtcaaagcgttggcggcattgaagcaacaaccggcagagcagcaagcagcgctgatcaagacacttttcagtggcgacgacggtgtacgcaaactgctggcgaaacccgaagacctgcaaaaagcgttttcgctggtcgctccggccaaactggaaggaacgtcgtcgcttgtgtcctcgcaagcgacccagagcagcctcgcatcgccattcaagggtgaggggggcgtgctccagtggatgggcaaacccggcgaggcacagacgccgctttcattgctcaagcccaatgatccactgacaccggcttacagcggcgcgattgaacgcagcgccgagcctgtgggcaaagaccctcagcgaagctggaacgcgttcgatgccagtctcaatcgtctgatcacggcgttggcgccggatgcgaccggcacgctggattcgctgacgaatatgaccaatggcgtggccgatatggctgaagcccatcccaagacctcgacggcgttggctcttgcgggcgttggactgtcggccatcgtggtggcggtgatggccaaggcattcggcaatttcaccgacaaactgctcaagggcgtcgcttcaaaattgccgttcggtcttggcggtttgattgccgatattgaagacccgaaagcaaagaaaacgtcggccggaaatggcgcgggccatgactgctgttgcaaaccgctgggcggcgggacggggggcagactcaagcctcgccggtcaagcatcaagcctcgagtccgacgtgaacaaaccggtcaaggtgcgaaaagcccccgcacggtgacccctcggccaccacggatcagtgctccaccggcaccacccgttctgccccgcatgtccggctcgtactggccgggaaccatgacggcatttgcaggctcatcagccgtcagttctgcaccggccgctccactgtccggttcttacgccagggcaggcagactgcttgccagacgggcaccgccgctgcggttgctcagcgccggatatgaaatggtcaacggcgtcatgagcggcgataagcgtgccgtcgtgtcgtccggtgcatcgttagccgggtcgtctgttggtgccgctgtcggtgctgcactgggtacgttgattctgccgggtgtgggcaccatggtcggcgggtggctggggagcatggcgggcggggccatcggtgaatctctgggcgacaagctagggacacaagtcgatcgtctcggctctcctgcacaggtcagtaaagacctcatcgcgacctcggcgacctccacgaaccctgcggcactcgcctccacagccgccagccagcctgtcacgttcaactccaccattcacatcaatggtcaggatcagggcagcgcccaggcactggccaatctagttgtgcagacaacaatgagtcagttgggccagatcatgccgaccaatcctctcgccacacgacgtgacgcagccctgaccgacggagtcgccacatgaaacaacaaatggctctgggcagtttcatcttcggcctgtcgcgcaactttgcgtaccaccaattgttgcgcaagtccgatggcggctggaccgaaatacagatccttaccagcaaaccgaaatccagtcagaccggacagaagccggaaaccctgaccatcaccggcaagtcgatgtacgccgtggccatggatcggctcgatgaattgcgtgccttgcaggcgctgcgtataccgctgccgctgatcgatggcatcggccgcaactgggggctgtggcgggtcaacaacgttcaggaaacccagacctgcatcatcgatgacggtacagcgatggtggtcgattgggtcatcgaattggcggagttcaacaatgcgtaaagttcgaagcgtggccggtgattcggtgaatctgctgctctaccgcgaaaccggtcgcagcgacgatgcggccgaagaagccctgtggaaactcaacccgaccctggccgaacacggcccggttctgcccgctggcatctgggtcgtgctgcctgaactcgacagcaaacccgccgcaatcaaagcgctcacggcgtgggattaaggaggttgtatggcattgggttttaccccggtcgttcagatttatggcgcaaacgcggatttgctcaaccagcgtcttatcagttgggagcacattgatgccgccggtatcgagtcggatcaactgaccctgaccattgatctggaaggcctcgaagggctgccgaacctcggcgggaaaatcggcctgctggtgggttacctggaaatggcagagatggtcgacaagggccagttcaaagtcactcgcctgacaccgacgctgtttccgtttcgcctgactttggtggccactgcagcaccgttcagcaaggatgacgagaccggcttcaagcagcgccgcaccgccagtcatggaccgacgacgctcggtcaattgttcagcaaactggtgtcgcagcacggattttcatcacgtgtcgcagcggacgtggcgatgatcaaaatcgcccatgtcgaccagtccaatgaaaccgacatgggctttctgacgcggctggcgaagaagtacaacctggtcgccaaaccttatggcgatgcgtatgtgctggcgcggcccgggcagatcaaatccatctcggggcagaaactgcaggatgtgacgttgtcggtcacccacaataatcgtccaggcgatcacgccttcatcagcgccacgctggaagaggccgcccgcgaacaggccaagggctgcaagacctgttttgtcgatgctgttacaggcattttgcattgggtcgaaacgggacttgcgccgttcaagaccatccgccagaagcaacccaatgaagccgacgccattgccgtgggagaaggcgaagtgcgcaaaatgctccggcaaaagttcaaggtgaagatcacctgcccgggcgatccgcgtctggccgctgaaggcctggtgctgctcgatgatacctggccggatttcatgcgcggacgctggtcgatcgacaaggtcaccgccagcggtaatcgcgagaacagctatcgctgcctgatcgatgcgtcgtgcctcgacccgaaagccgaagccaaagactgatctcacagcccacgagcccccctgtaggagtgagcctgctcgcgatagcggtgccacattcaaaaccaacgcgcctgacacaccgctatcgcgagcaggctcactcctacaggggcctgcggtaactcccactattttggaccacccccatgaagatcaccccgatcctcacgcaactgcgtgggcaatgccctggccttgccagtcacatttcggtgggtgtcgatctggcgctgctacaaggcaacccggatctgccgacaccctcggcccacgtgctgccactggccgacttggcgagtgaaagcaccacccaaaacctcaccacccgaccgatccgcgaccgcttcgaaatcgtcctggtgcttgacgccaccgacgctacaaaagcgctggatctgttgcacgacctgcgcgccgaactgtggcgcgcgctggtcgggttcaagcccgacaaagactacagcgccatcgtctacgacggcggcgaactggtctcgatcaacagcagccgcgctttctaccggctgcgcttttttgccgagttccagctcggccgcaatctgccaagtcagcctgcggagagttggcacgaacgcgaactggacggtttgtcgtcctttaccggggccaccgtgcgggtcgatgcgatcgacccggccgaccccaacctgaaacgcccgggccccgatgggcgcgtggaaatgactttctctgcagaggtaaccccatgagcaatcgcatcaccgtactgccggccgccggccgcgtcgtacctgacccggaggcgggcgatctgctgccgctcgaaggccgtgaagtgctggacagcgcctggtggcgccgacgtctggccgacggcgacatcactctcaaaaccgcaccagccaaacaaaagggagccaaataatggcgatcggattcagcaacatccccgcggacattcgtgtaccgctgttctatgccgaaatggacaactcggccgccaatagcgcgagttcgaccatgcgccgtttgatcgtcgctcaggtcaacgacaacatcgccccgaccgaagtcggcaaactggtgttggtctccagcgttgcgctggccaaaagcatcggcggccaaggctcgatgctcgcctcgatgtacgagaccttccgcaaggccgacccgatcggcgagatctggtgcctgccgctgcacaacgctgaaggcgccgttgccaaaggcgtactgaccctgactggcgcagcgactcaggccggcctgctcaacctgtatgttggtggcgtgcgtgttcaggccaccgtggtcaacggtgctaccgcagcccaagcagccactgcactggcgcagaaaatcaacgccacggccgatctgccggtcagcgctgccgctgccgaaggtgtggtcaccctgaacgccaaatggactggcgacagcggtaacgacatcagcctgcaattcaatcgcctgggcaagagcaacggcgaagaaaccccggctggcctgaccgccgcgatcaccgccatgaccggcggtgccggtgtgccggatcaggttgaagcgatcgccgcactgggtgatgaaccgttcgaattcatcgcactgccatggtccgatctgtcgaccctcaacacctggcaagccgtcatggatgacagcaccggtcgttggtcgtgggccaagcaactgttcggtcacgtctacagcgccaaacgcggcaccgtcggcactctggttgctgccggccaggcacgcaacgaccagcacatgaccattcaggcgctggagccgggcgtaccgcaaccgttctgggtacaagctgccgcactggccgcacgcaccgcggtgttcatctctgccgacgccagccgtccgacccaaagcggcagcctgccgggtgttgatccggcaccggccagcgaacgcttcaccctgaccgagcgtcagtcgctgctcaactacggcatcgccaccgcgtattacgaaggcggttacgtgcgcatccagcgctcgatcaccacctaccagaaaaacgcttacggtcaggccgacaactcctatctggacagcgaaaccatgcaccagtcggcgttcatcgtgcgtcgtctgcaaagcgtgatcaccagcaaatacggccggcacaaactggcctccgacggcacgcgtttcggcgccggccagccgatcgtcaccccggcgaccattcgcggcgagttgattgcgcagtacgccaagctcgaactggaaggccatgtcgagaacgccgagctgttcgccgagcacctgatcgtcgagcgcgacgtgcaggacccgagccgcgtgaacgtgctgttcccgccggattacatcaacggtctgcgcgtgttcgcactgctcaaccagttccgcctgcagtacgacgacgcggcttgattgctgcgtttgacgacaagcattcagcccacctcgcgtgggctttttcattaaagggagtaacaccatgggtcaactgattgcaggcacctgctacgtcaaagtcgacggcgcacaactgaccatcaatggcggctgcgaagccccgctgatggcggtcaaacgcgaaaccgtcgtacccggtttctacaaggaaaccgacatcgcgccgtcgttcaaagtgaccgcgctgcacaccgccgacttcccgctgaagaagctgatcgaaggcaccgatatcaccgtcacctgcgaattcagcaacggcaaagtctacgtgctggccggtgcgtatctggtcgaagagccagtctccaagggcgatgacgccaccatcgaactaaaattcgaaggcatcaaggggacctggcaatgagcggcgccgtgaagcttcaggttgcgatcgaagctcacggcgagcccctgaccgaactcgccctgcgccgcccgacggtgcaggaagtgcgagcgatcaaggcgctgccgtacaagatcgacaagagcgaagaagtcagcctcgacatggacgtggcggccaaatacatcgccgtgtgcgccggcattccgccgtcgtcggtcaaccagctggatctggctgacctcaacgcgctgagctgggccgttgcgagttttttcatgagtgcggcgtcggagccatcaccgacctgatcgcagtcgcctatgacctggcctggttctggaaggttgaccccgaacagatgatggccaggccactggatgtgctccgcgaatcgctggagcacgcgcaacggatcaatgcgatgcagcaggtgcagtgatggctattacacagataaacgcgatccagcaaaacgttcagaccacggtcaacatgctcgtggtcatgcaaggtctgcagaaaatggagaccgagatgaagggcgtccggggcaaagtcgcggcgttcaaaaaaagcctggaaagcactgggatcaagccgcttgatctgtctgggtttatctcgggcggtggcttgctcaagccgtttcaggagggcttgaaaaaggcgatcaaggccgaggacgaactggcgagcaaaagcaaaaatcttaaaaccccgacgctgggcaaggacgcccggattcccgcgccactgggggctcctgcaacggcgcaggtgcccgccgtggtgaagggcgaaacgtccaccaatcttgcgaagttcaacgtttcgctcgatgacatttcgttgaagatcggtcaggcgttgttgccggcagtcaatggcttggtgacggcgctggtgccggtcatgacctcggtcggtgaatttgtcgccgatcatccgcaactggtcgaagggctggcggcagcagcggtagcgttcaccgtcgtgacgacggcggctgcgggtttcagtgctgtgctcacgctgctcgcttcgcctatcggcctttttgccgccggggttgcattggcggcagggttgatcgtcgccaactggaagccgatctcagcgttttttgcccggctgtggcaacagattgctccggtggtgatcccgatggctggctttttccggacgctgttcggcttcactccgatggggatgctgatcaacaactgggggccggtcagtggcttcttcgcggcgctgtgggacgtactcaaagcgctggcggcgccggtcatcgacttctatgcgacgttgtttgcgtattcaccgcaggcgctgattctgaagaactggcagccactggttggtctgtttgcatcgatatgggatttgctcagggcggtgtcggtgccggtagcggctttttttcgcgaccttgtggattacatcaaactgccgatccttgcgctgtatgccgttatccgcgagcaattgggctggtcgcctctggagatgttcattcaggcctgggaccctttgaccgcctggattaaaaagtggagcgacacgttttacgaagtgctggcgccgatcagggattttttcaacggaggcctggggaaactcgcggccgaagcatcggccaaggtcgacgtgctcacccgctcacaggaaaaaaccaatgccgaaggcaaaggtgaatgggcgccgcaattccttggctccagcacggacgttacgtccaaaaccctgttgtcggcggggacactgacgcaatcctcgagctcactgacgcaatcctccagttcgctgacgcagacgtccagcgccctgatccagcaaagcgctgccaacaaccgcacgcaactcgaaggcggcctgaccgtacgcttcgaaaacgcccctgcggggatgcgcaccgatcaaccgcaaaccaatcaaccgggcctggcgctgtcttcgcgcatcggctatcgctcgttgtccgtgggaggttccaatgaactggcgtgaccgtttattgccggcatcctttcgcggtgtcggcttctggatcgattcggcgaaaaccccggtcggtcgtaaaggtcagctgcacgaatatccgcagcgtgacctgccgtatttcgaagacctcggccagcaggcgaggattcacgatgtcaccgcgttcatcgtcggcgccgattgcctggagcagcgcgacaaactgctcaaggcgttggaagcgggcagtggcgagctggtgcatccgtggctcgggcgcctgcaagtcaaggtcggcgaatgcgacatgacccacacccgtcaggacggcgggttggtgacctttaccctgaaattctatcccgataaaccgttgcagtttccgaccgcgaccgtcagtacccagcaggcaatactgctcaaggccgggacttttcaggcatcggcactggcgcggttcgagcaggcgatgacgatgatcaaagcggcgcggatcggcattgccaatttgcgtaacagtctcgccggcgtctacgagatcatcaaagagcagctccagccgctgatcaagtactacaaagacatcaccgacttcgtcaaagcggtcaaggagttgcccaaggaactggcggcggagttcaacggcttgctcggcgatatcaaggagctgaagacgtttgcgaaggaaggctaccgtggcgtgattgccgacgtgtcgcaacaactcgaagcgatccgcaaagctgatgcgccgaagctcactactggcaaggacaccaatgcggcggcgcaagccatggctgatctggtgcaggacaccctgatcgtgaaagcggcgcagtggatcgcttcgatgccggttgcaagcaaaccgatgaagttgccgtcgacgccttccgtcagcagtcaggcccaccagccgatcactcatcaggacgtgccgtccacggacgatacgctggcggtgctgaagaatctggtgagctcggttgatctggcgaagaacaaatacggcgctgcacatcaccaggtagccagcgatttgctggatgcattggtcacgcacctcaaggccgttgcgtcctcgggtatccgggttgtcactaaaaccattcaggaaagcgcgccgtcgctggtgatcgcctacaagtacctgggcgatgctacgcgggcccttgaaatccagcagcgcaacccgacgaatcaccccgggttctcacccaaccaagtgaaagtccccggggagtaaaccatgagcgagatggataaccgcgtcacgctgacggtcaacaacctggagtatggcggctggaaaagcgtggaaatcagcgctgatctcgagcgccagttccggactttcaaactcgacatcacctggcaatggccagggcaaacggtggataaaccgatcaagcccggcgacccctgcgaggtgaagatcggcaatgatctggtgctcaccggttacgtattcaaagcgccgattcgttatgacgggcggcagatcagcctgaccatcgaaggcagttcgaagacccaggatctggtcgattgcgcggccaccaatcgcccgggtcaatggcaggagcaaccgttgctgcgtattgtcgaggcgctggcgatggagtatgcgcaatcggtggtcaacgaaatccccgagaccgcacgactgaccaaacacaccatcgtgccgggtgaaacggtgtttcagtcgatcgatcgtttgctctcgctgctacgggtgttttccaccgatgacgagcaaggccgtttggtgttggccaagcccggcagcggtggccgggcgagcgatgtgctggagctgggcaagaatattctctcggccagcgcgccgatggattacagccaggtgttctccgaataccgggtcatcggccagcaaaaaggctcggacaagaagagcggggcggcggtcagcgaagtggaatcgattgctgccgacctgaccttcaaacgtcggcgcaccacggtgatcaatgaaggcacgcagctgacctttgaattggcgcagcagcgtgcgcaatgggaaagcgccacccgcatgggccgtgcgcagagcactacctatcaggtgcagggctggcgtcaggccaacggtgatttgtggcgacacaacacgctggtgcgagtgaaagatccggtactcgggtttgatggcgacatgctgatttccaaagtcacgtattcgctgtcggcgcagggttcggtgaccacgctgcaagtggcgccgccgcataccttcgatgccaatccgacacccccgaaaaaaacctgagcctgactccgaaccctgtgggagcgagcctgctcgcgaaagcgctggcagcttcaacatcacattgcctgacccagcgcattcgcgagcaggctcgctcccacagtggatcgcgtgatgcctaccttttgaggacaccccatgagcctactgacacgcttgctggcgcgcggcaccgtcgtgctcgccaattcggcatccaagctgcaatcgctgcaaatgcgcctcaccgccggcgaggtgaacgacgacctcgaacacttcgaaccctacggtttcaccagccatccgctggccggtgccgaaggcgtggtcacgtttatcggcggtgaccgttcccatgctatcgccctggtcatcgctgaccgccgctatcgcctgcagtcgctggctgccggtgaagtggcgatctacaccgacgagggcgacaggattcacttcaagcgcgggcggatcatcgatatcgaaaccaccacactgaacatccgcgccagttcggcggtgaacttcgatacgcccgtcatcaaccagaccggcaagattgtttccaccggtgatcaactggccggcggcatcagccagatcaaccacgtgcacgtcggcgtgcaagccggcagcggccagaccggcgcgccggcaggaggcaaatgatgttgatcagccctaatctccacgctgcgctgacccgcgccgtgcttatcagcctgttcacctggcgccgcgctgccgatgacgacgccctcgacgacgacgaacgtttcggctggtggggcgacagctttccgaccgtcgctgacgaccgtatcggctcgcggctgtggctgttgcgccgggtcaagctgacgcgacagacccagatggacgccgaattctatgcccgcgaagccctgcaatggctagtcgatgacggccactgcagcgccatcgacatcatcagcgaacgcctcgacgcccagcgcctgaacctgcgcacggtcctgaccctggccgacggcgaacgcctggacatcaaccccgataacagttggcaggtgatctatgccgtttgaaaccccttcgctaccggtgctgatcaagcgcacccaaagcgacctggccggcgattcgctgcgccagtccgatgcgcaagtgctggcgcgaacgctcagcggcgccgcgtatggcttgtacgggtacctcgactggattgccgagcagattctgccggacaaggccgacgagtcgaccctggagcgcattgctgcactgcgtctgaaccagccgcgcaaacccgcgcaagtggccaccggcacggtgagttttaccgccaccgccggcgcggtgctcgacgtcgatacgttgctgcaaaccaacgatggtcgtacctataaagttaccgccacacgcaccacggtcaacggcagcaacagcaccaccatcgccgcgcttgacgccggcagcctcggtaatgccgatgccggtctggcgctctctccggtgcaaccgattgccggggttgtcggcaacagcttcgtcgttgtcgaaccgggtctgagtggcggcgtcgctctggagagtctggagtcgctgcgttcgcgagtgatccgttcctatcgcgtcattccccatggcggttcggccagcgattacgagacctgggcgctggaagtgccgggcgtgacccgcgcgtggtgccgaggcggtttgctcgggccgggcacggtcagcctctacatcatgcgcgacgatgatccacaaccggtgccaaacgccgagcaactggctgaagtgcaggcgcacatcgagccattacgtccggtcactgccgaggtgcatgtgctgccgccggtgcaggtgccggtgacttacaaactcaagctgacaccggacaccagtgccgtacgcgcggccgtcgaaacccagttgcgcgacttgcacaaccgcgaagccgacctcggccaggacctgctgatcagccatatccgtgaagcgatcagcagcgccgcgggtgaaaccgatcacgtgctcaacgcgccgaccgctaacgtcgccgccgacgacagcgaactgctgacgttcggaggttgcgtatgggggtgatcagaaccgccgcgcaataccaggcgcaactgcgtgcgctactgcccagtggcccagcctgggatccggagcgagtcccggaacttgaagaagtgctgcaaggcgtcgcggtcgaactggcgcgcctcgatgcgcgcgccgccgacctgctcaacgagatggacccggccggcgtcagcgaactggtgccggactgggagcgggtgatggaactgcctgacccgtgcctgggcgccacaccgctgttcgacgaccgccgcctcgccgtacgccgacgtttgctcgcggtcggcagccaggccgtcggctactacctcgatatcgccaaaagccagggctatcccaacgcaaccatcaccgaactcgaagccccgcgcatgggccgctcgcgtttcggctcggcgcattggggcacgtgggaagcgcagttcatgtggacgctcaacaccggcgggcgcttgttgctcggccggcgttacggcgcgagctattggggcgaacgctttggcgtcaacccgggctcagcgctggagtgcctgatccaccgcagcgcgccggcgcacaccaaggtgcacatcaattatgactagggagtaagccggatggattatccgaaaagcatgcccggtgtcggtttggtcaacagtcgttttgtcgatgaaaatcccgtcaccggaacccccggatcgctgattcctgctgagtggggcaacgcccttaccgaagaggtgttggcggttatcaaagcggcggggatcgaaccgaccgaaggcttgaacacccagctgctcgaggccatccgtggcaaaaagctgtttgaaacgccgccacaattcgatgtcagtcagaaagtcgcgacgaccgagtttgtgcagcgcgcactcggcagtctggcggggcagaccaattacgtgggtgatgtttcgttgacggtcgctgacgtcggcaaactctcgatcttcaccagcccaggcacggtgacactgccggaatggtcaactgtgcctgcgggaggcttggtgtctctggtggcaggttccggtggtttgaacgtgaaagtcaggagtggcgagagtctgggcaccgccagcgctgttgcaccggataacacattgtcatttgtcggtggcagctacgttacttttcgccggcttctactcggcggaggatgggggctggactccggtgacggtgcgctcaagtactcgccagcgtttaccgcttccttgaacactgcaggcggctatcagcgtttgcccagtggcctgatcctgcaatggggactggccacgggcggcgcactcagcgaaaccattacctatccgattgcctttcccaaaagcgtgctctttctctcgggcggcgatctttcaccggcattctccgacctgcgcttttccctttaccgactctcgcaaagccagtttcagcgcttctccaatgctgaccctggcggctggaactggttcgccatcggcttctgaaatcaacggtgaatgaaatgaaatacattgattttgatgcccagggcgaactgcttgggcgctatgactcgacgattcacacgcaggtgcctgccactgccgtagagatctccgatgagctgttcctgcgcacgatcgaggaacgcgacggcatctggaagtggaccgacggcaaggtcaccaaacatgcattgccgaacgcatcgcagctggttgaaagcgaacagcgagcattggcgctggcgcggcgtgacgagttgttggccgaagctgatcagcaaaccgtcggtatggccgacgcctacattgcagggttgctggatgccgatgacatgcagcggttcaaggcatttgctacctacaaactggcgctgaacaagatcgacaggcagccagattatccgcaaagcgtggactggccagtgttgccggtttgatgccttttctgacttgaagcctacaaaaacagcttcttgaacaatcacccagaataacgggaggtcccggcgtggattatccaaacagtgtgcccagcgccggattggtgaatgggaagttcgttgatgaaaacccgatgaccggaaccccgggatcgttgattccggcggattggggcaatggggttacccaggaaattctcaacgtgatcaatgccggtgggctgaccccggacgagaagaaatacgatcagttgttgcaggcgattcagagcgtttcggccaagggctggaaccaggatctggcgttgccgattggctcattgccaaccgctaccgtggctacggcagatgggcgaatgccgatcacgccgtcggcggttgcaacaggtggcgggcgcttatcgattctgcccggtgtgttggtcagcctaggccaggaagtgttggccggtcagttggggcgtccgcgcacctttacgacgatagcctggagcagtgccgatctgttgcccaactccggttactttctgcgtgcgcaagtggtcgcgggtgtgctgaccttctacacacagcgcggcattatctatgacgccacgcccgagggattgaagggcacgatcaatggtgcggcgggcggtggttttcagtcgacgccgctggatctctgtctggcttgggtggtgacagccggccccggctcggtaccgattgtccgggcgatgtataaccgtagccgcttgtcgtggacgcaaacaatcagcggcaatggcgtggtgtacctgccactggacccgcatgcccgtgccgcgcgtctggtggtgggcaatgcgacgccgcatccgacacaagtcactgctgtgaattttgcgacacccggatggctgggcgccaactactgttttctcaacccgaaggttgccacgtcgagcaattgggacggctgggccagtgcgggggagacggtgcgggttattaccaacaacgaggtgaatgacacaaccgtttcgacattgaccgccagcttcgaccacagcatgttgcgttccctttggcagacctatcaagccgaacacgcctttggtgccgataacgggacgagtgatgagttgctgttcagcatgggcatcaaaaatattctcccgaccgactacgcaaacggtattgcgatcaacttttcagcggcggtgaatatcaatctttcctgggagttgatccgatgatcatcattcaagaattgcatcagttcgaagacggcttgcgtgctgcacagccttcaccggcccatgactgggacggtgaagcatggcagctcaatgcgggcagggtcgccgagctggagctgcaagaagccgaacgcctttgcgccagaatcgatgccgccgctgacagcgtccgcacggtgctggccggcgacccgctcaaagccatggaatacgcccaggccgccgccgatgctcaggcttatcaggacgccggttacccgaaaaaggaagtgccgctgtcggtcgctgcctgggtggtcaaagggcgtacggccaaacaggctgccgagcagattctcgccaaggccgatgaactgaccaatcacctgttgaccctgcgcaccctgcgtctgaaagccaaggcgcagattcgtgcgcagtccgccaaaggcaatctggagcaggcgcacagcgcagctgctgaagcattggtcgcgattcgtgagctggtcagcggtgtttccggctaagccagaaagccttcgttctgcgtcacccaagcccacgtccgcgtgggctttttattttcagaaaaccgaccgtggacggacacgcttaaaaagctttgccgacgtcgtcatttgtcatttcagaggaacgaacacccatggattatccaaaaagtgtccccagcgtcggcttggtcgatggccgcttcgtcgatgaaaacccggtggagggtacgccgggatcgttgattccggcggtgtggggcaacagtgtcactcaggagattctgagtgtgattaacggtgccgggctggtcgctgccgaagcggacaccggccaactgcttaaagccattcaatcgattgtcggcaccgccagtccgatgcgttcggtgattacccggttggcggcctcgaaaacactggccgaggcagaactcggcctcgtattgatcgatggcagtccgggcgcggtgactctgcagctgccgtcggccaatgccgcacttggtgtgcgtgatgtgatcgtcaggcgagtggacaacagtggcagtcgcatagtcatccaggcgtcgggtactgatcgtattcgctttcatacccatctggccgccagtggttatccgtttttcgtattaatgggcagcggtgactggtggcatctgcgcagtgatggcgttgggagttggtggccggtcggtcgcttcgacaacactccgctaggccggcctttcttcgagacgaccatcctgcttaaccccggcggatatggtgcactcaatggctctgtcatgaaacgcgccgaatggccctggctgtgggatcacgctcagcaatcaggaatgctgggagcagaggccttgcgctcaggtacggaggggaagtggaccacgggtgatggtgcgttgacgtttcgcgggcctgaagggcgaggggagtttctcagggttctggatgaggggcgaggagtggactccgcacgtgtgatgggcacctttcaaccggggtctactcacgcctatgcccaaggtgctaacggcggtggggcggtgggcgcttactggtccgatagcctcatcggttttggagcggatacccgagaggagccgcaattcatttcggggctgctcaacggtggcccgatttttcctgtgaacaccacctatcagcgagataccgcggccaccttgctttacgccttcaaatcccgccctcgcaacatcgcctatcccggccgcatcaaacttatctgaggcacttcatgttcaattatctattcgatggttcgggcgctctgtctggcccagtcgagtttcccgtcacacccggtatcggcattcaacttccggccaacgccgttgaactgtccttcgaattgcctgagccggaaaccggccgtagttgggcgttgatcaatggcgtaccccgtgaagtgattgaccgccgaggtgtggtgtatcgcaaggacgggggcgcgcaacagatctggagcgagctgggagcgttgcctgaagcccttacggcacagtcctggccgggtgagtttcatgtatggcgcgatgatgcctgggtgttggatgagcaggctcgaatggcgaatgccaaagcgcaggagctggaaaagcgcgacgtacttttgcgggacgccgtcctgcgtatcgctccgcttcaatacgccgaggacatcggtgatgcgagcgatgaagaacggctgcaattgctcgaatggaaacgctacagcgtcgaactcaatcgcctcgaaaagcagggcgggtttcctgacgagatcacgtggccgactgtccccggcgccgtcgtgaacggctgatttccacaaggagaagtgaaatggattatccaaaaagtttgcccggcaccggcctggtcaacggcaggtttgtcgacgaaaacccgttgaccggggccatcgggtctttgattccagcgcagtggggcaatgctgtcactgaggaagtgctgaatgtgattcagtcggctggcctcgcagcggatgagcaggacaacgcccaattgaagtctgccatcgagcagaaaatcacccagagtgtggtgcctgtggccagtgttcaagacgcggagcagggaaccgacaacgttaaacgcatgactccgttacgggtttttcaagccatcgccaaacgcgtggtgcaggcgagcgaaagcattgccggggtggcgaagatagctactcaggcgcagaccgacagtggcgcggataccaccacgatcgtgacgccgaaaacgctgcgctttggcttttctaccagtctgaccaccaacggctacattgtttttccttcctggctgggtggtttcatcattcagtgggtcgggctgtcgaccttaggaattcaaggggcatattcgagttttaccttggcgtttcccaacgtttgccttgcagtatttccatccactttgaatggatcggctccgggcagtgtttcgctgggtgcgaaaaatcagaacggtttcacgttgtactcggaactgttgccttgcggcttttgtgcaatcgcgttcggacgctgaggagtaaccatgaagcgtttttatagtcagtccacaggctgtgtgtacctgtccggcatcaatccaagcatgccgagcgatgcagtaccgatcactgaggagcgtttcatcacggtgatcggcaaccctgcgcccggcaaaatccgcagccatgatgccgatggtttgccagtgctgatcgatgctgcgccgctgtcggatgccgaactttcgatgctggcgcgcaaatggcgcgacgggcagctgttggccagccaatggctggttgatcgtgatcgggatgaggaggccgcaggcagaccgatgagcctgagcatcgaggaccatcaggagcttctggactatcgccaggagctgcgggactggccgtcgagcacgggttttcccgcagacgcgagtcgacccttaccgccggactggctgatgcgaatgctggctgtggcttgatgtcgcgagttgaacagagtgttacagccatttttgccaacgcccgcctatgcgggcgttggcgtttcatgcgacctgaaaggagctgaaagtggattacccaaaaagcgttcccggctcaggcctggagaacggcaggtttgtcgacgaagaccctatcgccggaaagcctggctcattgatcccggccagttggggcaacagcgtcaccgaggaaattctcagcgcgattacggccgccggtttgaccccggatgaagagcagaccaatcaactggcccaggcgattcggcagttagcgaaacccgacccgttgcagcaattcccggtgcaggtgtaccgcaagaatctgttgatcaatggtggcttcgatatctggcaacgcgggacgaccaaccaggcaccgaatgtgggtggttacgtggcagaccggtttcgctgtgactggaacggtaacgcggctgtggcgatcagccggcagagcttcgtcccagggcaaaccgaggtggctgatgagccggcctcttttctgcgctggcagcagacgacggcgggcgttggcgcaacggaacacaaaatttcccaggccattgaatcggtgcgaacccttgccgggaaaaccgccaccgtcacgttctgggcgcgatctgatgcggcgcgcgcactgaaagtagcggttacgcagttttttggcgcaagtggttcggaacccgtgaccaaagcggtcgaagcctttcagttgaacacagcctggacaaagtacagcgcaacatttcaggtgccgaccattgccgggaaaatgctcggcaccaatgattgcctgagactggcgttcgacctgccgctcaacgtcgtacagacggttgatctggcgcagatccagttggaagaggggcctgtttccacgcctttcgaataccgtccggttgctgaagaattgatgctttgtcagcgttacttcgagaagtcgttcgccaaccgtctaccgattcaggcgaacaatggcgccggcacgtgcattctttcgtttagccagtcggcaggaggcaacgctggtcaatatggcctggccatccacatgcaggtactcaagcgagtgcaaccgactgttgtgctgtattgccctgcaaatacaagtaatcaggtttggaactacacggcacaaacagcgtgtacggggacattcatacacggggtgacccagcgtactttcgcgatcagcacggtaacgccccccaacagcgtgcccggtcaagcattgcagattgaatggacagccgacgctgaaatctaggagtgaactcatgacctatcaactgactccttgcggcgtattgcgcatggaggattcagcattcatcccgcaggacccgaccaatcgcgactgggttgagtatcaggcgtggctgtcatcgggcgggcaggtgctgccagtggacgaaacacccgaggcggcagcgggcaccctgaaaactctggcaaataaatggctggcaggcattggtcgccagccgtgattcaatcggggccatatccagggaggatcaagcattatgcaaataactgaaaacaaccttatcgacatcatgcccaacgcccgctcccaagcgggcgtttttgtttctgtgctcaacgccgccatgactcgtcgtcttatcgatacgcccaaacgcatggctgcgtttctggcgcaggtcggccacgagtcggggcaactgcggtatgtgcgagagttgggcaacaaccaatacctgagcaagtacgacaccggtacgttggccctgcgtctgggcaatacgccagaggctgatggcgacgggcaaaagtaccgcggacgagggctgatacaaatcactggccgtagcaattaccgacaatgcagcgttggcctttttggtgatgagcggctgttgtccttgcccgaactgctcgaacaaccgcaatgggcggctgagtccgccgcttggttctgggagcagaacggcttgaacgaactggccgaccgcgaccagttcaacaccatcacccggcgtatcaacggcgggttgaacggtttgcaggatcgtctggaaatctgggcgcgggcgagggcggtgctatgccaatcccctggcgtgtgaccagcattctgttgctggccgctggtgcctttgcagccgcttggcaatttcaggactggcgctacggacggcaattggcggagctggctcggttaaacgccgaggtactcaatcaacagaattccgccgccgccaccgcgcaacaggccgagcaggataagcgcctggcactggagcagcggcttgccgccagtgaacaaacccactatcgagcactgagcgatgcccaacgtgatcaggatcgcctgcgcgatcgtcttgctactgctgatgtacggttgtcagtccttctcgacgccagtgacattgcaccaggctgcaacatgccagccaccgccggcgccggccgcgtggatcctgcaaccgtacgcgcccgacttgacccggcgcatgctcaacgaattatcgccatcaccgacagcggcgaccgcggattgattgccctgcaggcctgtcaggcgtatgtcagagcgctggtgcccgaacattttgaatgagtctgtgtattgaaagcgcaatcggctcgtgtacggtggaggcattccacacgatccggagcatgccgtgaaagaaatcacccaattggctgctgaacttggccgacgcctgcaagtgctcaacgcccacgtcaccacggccgagtcctgcaccggcggcgggatcgccgaagccattacgcggatcccgggcagttcagcgtggttcgaggctggctatgtgacctactccaaccggcagaaaacccagcagttgaatgtgccggccgggttgttcgagacggtgggcgcggtcagtgtcgaggtggtcgaggcgatggtgcggggcgcccaggacaaaagcctggcgcgatttgccgtggcggtcagcggtgtagcagggccggacggtggctcgccgaacaaaccggtcggcactgtttggctggcctggggtgttggcgagaccgtgaccagtgaggttcaacacttccccggcaaccgcgatgaagtccgccgacaaacggtgaaggccgcgctagaggggctcctgcgactagcggcacgagaaatcgaaaatcaggggtaggcgatccgcgaacgctgtggaataatactggctacttatacaggtgttggccgtcaggccttattgattacgtgaggactttaatggacgacaacaagaagaaagccttggctgcggccctgggtcagatcgaacgtcaattcggcaagggtgccgtgatgcgtatgggcgatcaggaccgtcaggcgatcccggctatctccactggctctctgggtctggacatcgcgctcggcattggcggcctgccaaaaggccgtatcgttgaaatctacggtccggaatcttccggtaaaaccacactgaccttgtccgtgatcgcccaggcgcaaaaagccggcgcgacctgcgcattcgtcgacgccgaacacgccctcgaccctgagtacgccggcaagctgggcgtcaacgtcgacgacctgctggtgtcccagccggacactggcgaacaggccctggaaatcaccgacatgctggtgcgttccaacgcggttgacgtgatcatcgtcgactccgtggcagccctggtaccgaaggctgaaatcgaaggcgaaatgggtgacatgcacgtgggcctgcaagcccgtctgatgtcccaggcgctgcgtaaaatcaccggtaacatcaagaacgccaactgcctggtgatcttcatcaaccagatccgtatgaagatcggtgtgatgttcggtagcccggaaaccaccaccggtggtaacgcgctgaagttctacgcttcggttcgtctcgacatccgccgtaccggcgcggtgaaggaaggcgacgaagtggtcggcagcgaaacccgcgtcaaggttgtgaagaacaaggtcgcttcgccgttccgtcaggccgagttccagattctttacggcaagggcatctacctcaatggcgagatgatcgacctgggtgtgctgcacggtttcgtcgagaaatccggcgcctggtatgcttacgaaggcaccaagatcggtcagggcaaggccaactcggccaagttcctggcggacaacccggaaatcgccgcgaagctcgagaagcaactgcgtgacaagctgctgactcctgcagtgatcgactccaaggcttctgcagtcaaagagactgaagatgacctggccgacgctgacatctgattgcagcgatgaccaccgccgtactcgataccctcgtcgctgtgcggcgaaccgccatggacctgctcgcacgccgcgagcacggtcgagtcgagctgacgcgcaaattgcgtcagcgcggcgctgaggcggagatgatcgaaaccgccctcgaccgtttgacggaggaggggctgctttccgaagcccgttaccttgaaagctttgtttcctatcgtgcccgttccggctatggccctctacggattcgtgaggagctgagccagcgcggtttgcagcgtgccgatatcgaactcgccctgcgcgaaagcggtatcagttggcaggagcaacttcaggacacctggcgcaggaagttctccggacatttaccgattgatgcaaaagaacgggccaagcaaggccggtttctggcgtatcgagggttttcgatggagatgatcaaccgcttgttcagcggtcgaggcatggacgattaatccgattcaataaaaacggcccgctatgaaaatagcgggccgtttttttttgccctcaaataacctttgatggttcgcgtgagcgttgcgctgtttgcggtttggaatcagcccagttttccggcaggttgatgtaatcgatcagttcccgcagacgcccgtgggtgcgcgcgttgaaggcgaaggccagtcgcgccagatgactgaactgcgcttcatcgtgttcctcgccggcgtaggcgtgctgatgaaactggtcactcaggcacagatcggcaaacgcttcctgcatgtgcgccagcgcctgatcgctgagcttgtgatgcatgcggatcacgaattggcgcttgagccagcggctggagtggaagttactgtagaactgattgatctgctcgaccgcctcttcgacgctgtaaaccaggcgcatcaatttcatgtcggtgggcaggatgtaacggttgtcctccagttgctgacgaatgaagtccatcgcgccttgccagaatgtgccgcccggcgcatccagtaacaccaccggcaccagcggactcttgccagtctgaatcagcgtcaacacttccagtgcttcatccagggtgccgaatcctccggggcataacaccagcgcatcggcttctttgacgaagaacaatttgcgcgtgaagaagaagtggaaaggcaacagattgccggtgccgtcgacggtcgggttggcatgctgctcgaagggcagggtgatattgaacccgaggctgtgatcgcgacctgcaccttcatgggcggctgccatgatgccgcccccggcaccggtgatgaccatcatgtccgaacgggtcaacgccgcgccgagttctcgggccatggcatacagtggatgttcgactggcgttcgcgccgagccgaatacggtgactttgcgtcggcccttgaattgctccagcacccggaacgcttgctccagttcgcgcagggcttgcagggtgatcttggcgttccagcggttgtgatcttcctgcgccatgcgcagcacggtcaggatcatgtcgcggtagatgggaaggttggggctgttgggggaaacccggctgagttgttcttcgacctgagtaatgaggtcgggaccgttttcctgaaaatgacgactcaagaggtcattcggttggtaaggcattcaacgtctccttctgcacagagcgggatggccctgacgagcggcgtcagtgccgcgctgcaaaaaaacacacacgatcggcagttcctttcctgccgtttaaaaatgatcgggaatactctgaatctagacccttgcgaagctttgcgctgactcgatcattgcgccgcaacgttctggctggcaaccgtttattgtttttcagccgatgccgtcaccgctcgtccgaacgtgcgccgagcggcaatccctctgattaactaacttacaggcgccgtacgacaactttgcgttaacgaccgtacgcaaggtgcacgctattcaaggatttgcgggtggcaaggaggcgggacacatggccagagtgattctggagatcgatacgcagttgtatcgaatgttgaaggcatctgccgagaccaatcatctcagtctcgaagaggagtgctgccggcgcttggccggcggcgagcgccgttcgcactatctacaggccttgctggccgaactgcgcgccgaggatgaacagcggcgcgccaattcgcgatgattacttcttcttcgccgggccggctttcgggcaatccgattcctggtagctggcggagccgatcgctttgttggttttcacttccgtgaagtcgtaacgcatgattgcgcccttggccatcagcttgcgaaacgacgggttgttgcacaccgaagcgcccaactggaaatacacggctttagggtcagcgcgcatcttgtcggcgtggctcttttgcacactcaggtggttgatcaactgcgtgccttcaacggtgaagccctgatcaagaatgtcttcactgatggcgcgtggcgtgccgacgctgctctgggcggcgacgttgcgcagctcgcggttcagattctgctcactcagggaggcagcctgagcggtgaaggacgacgccagcagaatggcagcggtgggaacgataaggcgcagcatgaaactctcctggttcagtgactggtggttcgaccagccacgtgactgtgcgttcagtggcggcgaattataggggagccggtcgggagggtacaggcttgtgcccatcgctctggtaaactgccggcctttattgccctgccgagtgtcgttcgtgtcgagttttcctgcttttcggcgttatccacgatgaaccatgcgcccaacgccgtcgcccgtctgcgtgaccagcgcgaagatgaaggcatcaagccgattcaggcccgtggctttcgctctgagcgttgccgcgactgccgggtgatcatcagccattgcctgtgcgcgtggcgaccgagcgtcgacactcgttcgggcgtgtgtctgatcatgaccggcaaggaagtgttcaagccgagcaacaccggttggctgattgccgacgtggtgcgcgataaccacgcgttcatctggtcgcgtaccgagcccgatccgcagatgctcgcgctgctcaatgacccgcagtggcagccgtatctggtgtttcccggcgaatacgttgaaccggcgcgagtgaccaacaccgtcgcgatcgatagcagcaaacgtccgctgttcattttgctcgacgcaacgtggactgaagcgcggaagatcttccgcaagagcccgtatttcgatcgtttgccgatcttgagcctgctgcccgacaaactctcgcgctaccgcttgcgtcgttcgacccgcagcgaacatctctgcaccgccgaagtggctgcgctatgtctcgaactggcgggtgacagcgacgcggcttctgcgctggacgcctatttcgacgtgttcagccagcactacctcggtgccaagcaacaactggacatgaatgaagccacccccgcgcacgccgagctgttgccctatataagaaaggcgcagccggagttggcccaatagtggcccatactgtacaagccagcggccgtgctgcttgaccaccccgtcttcgctgggcatgcttggcgccgattagggtgcggccaaggtttgaaacgccgtgtttgctgttgattggcgttgaacgtgcccctgtggatatcgcttcaaaagcggcatcttgagttgctttggccagaccggaatgcaccgtgtctgccatcaaaaacaggatcatttgaaaaatggccacatacgacatcctgattgccgatgatcaccctctgtttcgtagcgccctgcatcaagcggtgacgctgggccttggcccggatgtacgcctggtggaagtggcgagcatcgccgaactggaaacccgcctgaccgaaaaggctgactgggatctggtcctgctggacctgaacatgcccggcgcttatggcttttccgggctggtgctgctgcgcggacaatacccgcagattccggtggtgatggtgtcggcgcaggaagaagcgtcggtgatggtcaaatcccgagagttcggtgccagtggctttatacccaagtccagcgacctcagcgtgattcagcaagcggtgcgcaaagtgctcgatggcgatgtgttctggccgccgcaagcgttcgaagcggtcgccgtttccgacgaagccaaagctgccagcgatggcctcgccagcctgacgccacagcagttccgcgtgctgaccatggtctgcgaaggcctgctgaacaagcagattgcctatgagctgagcgtgtccgaagcgaccatcaaggcccacgtcacggcgatctttcgcaagttgaatgtgcgcactcgcacgcaagcggctttactgctgcaacaacttgagtcaattccgagccaataaaggctggtgtcttcacgtttttttgacttttattgatctagctttcccactcctttttggttggtttcttccttatgtcacctttcaagggccaaaccggcctgaaacgcatcctgaatgcctccggttattcgctcgacggtctgcgcgccgccttcaccggtgaagcggcgttccgccaactggtgctgctcaatgtggtgctgattccgctgacgttcttcctcaatgtcagccgcgttgagcaggcactattgattgcagtgtgcctgctggcgctgatcgtcgagttgttgaactcggcagtagaggcggccatcgaccgcatctcgctggaactgcatccactgtcgaagaacgccaaggacatgggcagcgccgcgcaattcgtcgcgctgagcatgatcgcgctggtgtgggcagtaattttgctttaagcgatggtcggcaaaacaatctcgtcgctgcgctgaaccccggcggtgaacgcgcggcacagctcgagaaactcgcgcatcgccgaggtctggtatttctgcttgtgccagatgaagtagaactgccgcgccaggtccaggtccggcgtttccaccggcaccagactgccgcgtcggaacgcatcgcgcagtgccagtcgcgagatgcaaccaatccccaaccctgattccaccgcgcgtttgatcgcctcggtgtgttccagctccagacggatattcagcgagctgcgatggtgacgcatggcctgatcgaaggtcagccgcgtgccggaaccctgttcacgcagaatccacgcctcgtgagtcagctcttccatggttgcgctgccgcgctgggcgagcggatgttgcggcgcgcagaacaccaccagctcatcctcgacccagctctgcacttcgatgtccgggtggctgcaatcgccttcgattagacccagatcaatttcgtagtgggcaacttgttgcacgatattggcagtgttttgcacgtgcagcttcacttggctttccgggtggcgctgcatgaaactgccgatcagcagggtcgccaggtagttgccgatggtcagcgtcgcgcccaccgacagcgagccgaaaccggatttgccgttgagcaggtcttcgatttccttggcctgatcgagcagggccaccgcttgcggcaacagttgtttgccgagggcgttgagactcagccgtttgccggcgcggtcgaacagctggcagctggactgacgctccagttcggtgatcgaggtgctggcagccgactgcgagaggttgagcagacccgcagcacgggatacgctttcctgctgggcgacggcgacgaagacttgcagttgacggagagtaaatcgcatatcgatataaccgataacccttatcttaataatccagttaacagatattgtcgtcgctattagaatgcgatgcaattgcgcaccgtcgccttcaaaagccagcgcagacccaatctccaggagtcaaacgtacatgagcaacatgaaccacgagcgtgtcctcagtgttcatcactggaacgacactctgttcagcttcaagtgcacccgcgatccgggcctgcgcttcgagaacggtcagttcgtgatgatcggcctgcaacagcctaacggccgcccgcttatgcgcgcttactcgatcgccagcccgaactgggaagagcatctggagttcttcagcatcaaggtgcaggacggcccgctgacctcgcagctgcagcatttgaaggaaggcgacgagatcatcatctcgaagaagcctaccggcaccctggttctggatgacctgaacccgggcaagcatttgtacctgctgagcaccggcactggcctggcgccgttcatgagcgtgatccaggacccggaaacctacgagcgctttgaaaaagtgatcctggtccacggtgtgcgttacgtcaacgaagtcgcctaccgcgaattcatcaccgagcatctgccgcagaacgagttcttcggcgaagcgctgcgtgacaagctgatctactacccgaccgtgacccgcgagcctttcgagaatcagggccgtctgaccgatctgatgcgcagcggcaagctgttcagcgacatcggtctgccaccgatcaacccgcaggacgaccgcgcgatgatctgcggcagcccgagcatgctcgacgagaccagcgaagtgcttgatagcttcggcctgaagatctcggcgcggatgcgcgagccgggtgattacctgatcgagcgtgcgttcgtcgagaagtaagtcccactgaagaagcccccattgcctgaattggcaatgggggcttttttatgcccgcgacattcacctgtaggagctgccgcaggctgcgatcttttgatcttgcttttgaagagcaaaatcaaaagatcgcagccttcggcagctcctacattgagcgaggtttcaggtgttggcggggatgacttcgagcacgcggatctgctcaggcgtcgggtaatgccagcgcacgtccagatcccagaattgcgcgccatattcgcgttcaggcgccggggtttgataggccggacgcggatcctgagccaggcactgttcaatcagctcaaccaacggctcgtcgaggcgctgagcgtgtgtatgcgcttgtttcagggctgagtcggtccactgcacctcaatcagctgtggcgcggcgctggcgatgctgttggcggcgtcgggaatgatgtcggcgtagggcacgtagggtttgatgtcgagaaccggcgtgccgtcgagcaagtcgatgccggagatgaacaggcgattggcttcgactttgtccagtttcaccacggactggccgatgccattaggacggtgtgtggcgcgggtggcgaatacgcccatggacttgttgccccccaggcgtggcgggcggactttcagtcgcggtttatcttccagcgcttgatgaaacaggaacagcagccagacatggctgacctgctccaggccttgcaccgcgtcaccctgatcgaacggtgccaccagttccagcacaccacgggcggcgggggccagttgtggctggcgggggatggcgaatttctccttgaaacaggagcgcacgaagccgatgggggagacgctgtaagtcatggtttgcattcgaagcggggcaggggtgggcatgataacccggcagaccctatggctggtggagactgggctgacgccatcgcgagcaggctcactcctacagggtcatgggtgtacacaaaatctgtgttcgctgaaaatccctgtaggagtgagcctgctcgcgatgcttcaccgccgatgtcagagactaaacccgccatccagcggaataatattcccggtcatataagccccagccgtactcgccagactgatcgccaacgccgccatctcctcttcacgcccccaacgcttcatcggaatcagcgccgtgtcctcagccaatgcctgctgatcgctgccaatatgctgagtcatcttgctcggaaaacgccccggcgcgatcacgttgacgttgatgtgctggctcaccagctcccgcgcgagaatccgcgacaactgatgcagtgccgccttgcttggcccataggcatacgcctgctcaccaaacgaagaaatccccgccaccgaaccaatgttgatgatccgcgccggattcgccgccgagccggccttgcgtagcaacggcagaaattgctgaatgcaggtgaacaccgaggtcacgttgagctgcatgaccttttcccagcccttcaccgggtagctctccagcggcgcgccccaggtggtgccggcattgtttaccagaatatccagatgggtgatctgctcgcccaggcgcgcggccagttcctgcacaccttcttcggtcgccagattcgccgccacgccgtggcacgtgcccaaggcgctgagttcttccgcagtttgatggcaggcttcggcgtcgcgcgagcagacgtaaacgcgcgcgccagcctcgacaaaggctttggcgatcattttgccgataccacgggtgccgccggtcaccagagcggtgcggccttgcagggagaaatacgggtgcatggcgagtcctgaagattggggatcagtacaccctagtcgccagccgcgcgaagcggagccattatttctggagggaatgaacagtcatgcgttgcggtggcgaccatcggtcgccaccgcggaggggatcaggccggacgaacgcgcagggtcaggcccttgaggaaattgcgcagcaactggtcaccgcacgggcgatagttggtgtggccgaccttgcggaacagcgcgctcagctcaggcttggacaccgggaactcggcagccttgaggatcgcgtgcatgtcgtcttctttcagttcgaaggccacacgcagctttttcaggatgatgttgttggtcaccggcacttcgatcggctgcggcggacggctttcgtccttgccgcgcttgaagatcaccaggccgtcgaggaagtgcgcgatgacttcgtccgggcagcgcacgaaaccttcttcgtcttcttctttcttgtcgagccaggtcactacgtcagcgagcgcgacgtccatgccgccgagcttgatgatctcgacaactttcttgtcgctgatgtcgagcatgtagcgcacgctgcgcaatacgtcgttatgaatcatgtgagtaatcctgatgcgttgtgggcagcgcgcaggcgcgctaccggaatgtgtggcggcagtggaagtcttagaacttctctttgccggacaggtagcgccattggccgaccgggactttgccgatcgagacgccgccgatgcggatacggcggatgccgacgaccttgaggccgaccgcttcgcagaactgcgcgatgatccccggctgcgggttcttcatggcgaagcgcagacggttttcgttctgccagctggccttgaccggcggcagttccttgcccttgtgcgtcaggccgtgctgcaggcgattgaggccgtgggcgaccatgtcaccttcgacttcgaccacgtattcctgctcgatcttcgcggcgtcggcggtgagcttgcgcaggattttccagtcctgggtgaacaccagcaggccgctggccttggcttgcaggtcagcgctggcggtcaggcgcagaaagtggccgcgcagagggcgcttgctgaaacggtgctcttcgctaagggtttcggcgctgagcgattgcatggccgtttcgacgtcgatgccggcaggggcattgagcaggatggtcaccggctccggtgcggtggccttggcgtccttgtcgagctcgactttctgctcgccgaccttgaattgcggctcgtcaatcacttcgccgtccacggtgacccagccgccctcgatgaacagctcggcctcccggcgggagcaaccgaccagttcgatgaggcgtttggagaggcgaatcgggtcagtcatgacagggccgtaacaaaaaaggggtgggcattgtacctgtgtggcgccggttaagcccggttccatttcggtaatgctttttgtaggagtgagcctgctcgcgatagccatctgacattcgacattgatggtggctgatctggcgctatcgcgagcaggctcactcctacattgggttgggttgtgtcagccgttactggagcgctgctggttctggcgcaagcgcatatgcagcaacggatacggctggcccatgccatcgacctccgagcggccgatcacttcgaaaccctgcttgaagtaaaagcccaaggcctgcgggttctgttcattgacgtcgagttcatcggcattcagatgctgcatggcatagttgagcagcttcttgcccaagccctgaccccgataatccggatcgataaacagcatctcgatcttgcccgccgcgacaccggcaaacccggtgatgcgctggtcggcgtccctggtgcagatcagcatcaccgcatccagataacgcgagagcaccagattgcgcagcaactcgatgtagctgtccggcagaaaatcatgggtggcgcgaaccgaggcctcccagacccgggtcagttcctgataatcgctgagtttcggtgtgtggatgaccgaatggtgacgcatgcccgtctgcctcttgtccgtttcaagggagtccgtcccccgctaaacgatagccgtaaaaaagccccgcatcttgtaaaaagagtggggctttttgtatttgttgcggtgtctggctggatacttctgtcgccagcaagaactctccccctcaccccaaccctctcccccaagggggcgagggggaagggagctgatcttcgtgctgttcaaaacctgagttcgaccggatagctcaggtcgatgtacctcgaaagaacaacacggtcagctccctctccctctgggagggggcgagggggaagggagctgatcttcgtgctgttcaaaacctgagttcgactcgaacgttcaggtcgatgtatctcgaaagaacaacacggtcagctccctctccctctgggagagggctggggtgaggggcttttgacgtttagatctgctcagcccacaggtcatattcgtcagcatcagtcaccttgcaccagaccttgtcacccggcttcagattactgccgttgtcgataaacacgttgccgtcgatttccggggcgtcgaagaagcagcggccaaccgcgccttgctcgtcgacttcgtccaccagcacttcgatttcacggccaatgcgcatttgcaggcgtgccgagctgatcgcttgctggtgcgccatgaagcgatcccaacgatcctgcttgacgtcgtctggaacaatttccagatccagatcattggccggagcgccttcaaccggcgagtactggaagcaaccaacgcggtcgagctgggcttcggtcagccaattcagcaggtactggaagtcttcttcggtctcgcccgggaagccgacgatgaaggtcgaacggatgatcagatccgggcagatttcgcgccagttcttgatccgcgccagggtcttgtcttcgaacgccgggcgtttcatcgacttcaacactttcgggctggcgtgctggaacgggatgtccaggtacggcaggatcttgccagcggccatcaacgggatcagctcgtcgacgtgcgggtacgggtaaacgtagtgcagacgcacccagacgccgagggtgctcagcgcttcacacagttcggtcatgcgggttttcaccggcgcgccgttccagaaaccggtgcggtatttgacgtcgacgccgtaggcgctggtgtcttgcgagatcaccaacagctctttaacgcctgatttgaccaggcgctgagcttcgtcgagcacatcaccgaccggacggctgaccagtttgccgcgcatcgacgggatgatgcagaacgagcagctgtggttgcagccttcggaaattttcaggtacgcgtagtgacgcggggtcagcttgatgccttgcggcggcaccaggtcgatcagcgggttgtgatccttacgcggcggcacgacttcgtgcacggcgttgaccacttgctcgtactgctgcggaccggtcacggccagcacgctcgggtggacgttgcggatgttgccttcttccacgcccatgcaaccggtgacgatgaccttgccgttttccttgatcgcttcgccgatcacttccaaagactcagccttggccgaatcgatgaaaccgcaggtgttgacgactacaacgtcggcgtcctgataggtggacaccacgtcatagccttccatgcgcagctgggtcaggatgcgctcggagtcgaccagtgctttcgggcaccctagcgatacaaaccctacacgtgggttattactcatatactcacaacctgcagggcttgccctgttgaaatttaaggcgcgcgattctaaacgctggttaaaaaatgcgcaaaaacaattgtcgcaaacgaatattgttctcatgcagggaaggggagttcagaagtgtctactaatcaaaagacgaccgaaagaagcgccaatagagaaaagggcaagtatgagtctattcggatagttgactgggaaaaacaaagggagaaggcccttaacagacgaaagttgtttgggacggctctccttttcctagcatttgttatgtttacttttgctctagatgttattccgctttcattggattttaggctgcgagttattgatgcttggcagtttaagttgattgttgtaacgctttttctgttgatgttctttcgtatttggactctagattatttttcagaaagtacttcctttgtcgagttggatgaacgtaatcgaatcgagaagtctaggtactccagagcggaagtagaggactctgctgaaaaagaccatgtgccgattcttaaatctgctgaacaaaaaaaatcgcgtaaggtggtctctgggtttgagtttggagagcatatgcgctcaatcattgagtcgcttgactttcagattgattacgcggaggagaaagcttctcggctgttggaggtaggaagaagttttgttaggggggggattacgttatatgtatttaatattgttgtttggcaaggttacttgttttatatagattttaaggttaatgccggtattgtagttgggatggcctccactactgtaatatttttgataatggagtttattggggcttggtatctgaagcaatatagacattatggggattctgcgttttcttatatgaaggtaaggtcgtcatacaataagtatatgttgtcctattgtgcgatattggaatttactggtaatgatctttcgaaaggtagagaagaacttttgcgtgtattggctgagtctgagcgttggccagagcttaaagatgtcaactccaatgatttcaattacatgattcagtctgtcgaatctatgggggcgatctttgataagctaaaaggaatgtttggtcatgataacggttctggtaatagactttgaaagtccctctcaaggtttatagctacctgaggttttctgatccacgccaagcgatgggtagtagcgcagatcgccaacttgcttacgctgcgtcttgggctgcagaacgaaacatgatattggacgctacactaaccttgaaagatgaaggtttgtccgcctatcaccagcatcatgtcaaacaaggagcattgggcgtttttcttcgggccatcgaggacggccggattgccagtggatcagttctggtggtggaaggcctagaccgcttgagtcgagctgagcctatacaggcccaggcgcaattggcccagattatcaatgcaggtatcacagtcgttaccgcaagcgacggccgcgagtacaacagggcgggtttaaaagctcagcctatggacctggtttattcgctcctggtgatgataagggcgcatgaagagtccgacacgaagagcaagcgagtcaaagccgcaatccgtcgtcaatgtgaaggttggatatccggttcgtttcgtggggtgatccgcaacggtaaagacccacagtgggtgcgattgaccagtgagggatgggagttgatcccagagcgtgtcgcagcagtaaagcgggcgcttgagctttatcgtttgggactaggtgccggccgtgctgcaaacatcatgcatgaagagggatttcaactgactgagggaggaatctccggattacagatttaccggacgatcaagttgcctgcgctgcggggtgtcaaacggttgagtctggagggcgaagactacgagctggaggagtattacccgcgtgtcctgtccgatgcagaatggaatgatcttcagcaccttgctggccaacggttgcgtcggcgaggagcgggggagatcccaggcattatcaccggggtcggattggcctactgcggctactgtggcacagcgctagttgcgcaaaacataatgaagcgtaggcgggtggatggaagcattgcagacggcaatcgcaggttgcactgcacttcttacagtaaaaacggcggatgctccgccggtgggagctgcagcgttgtcccaattgagcaagctctactcaagttctgcacagatcagctcaaccttcagcgactgatgcagccaagcgatgatggccaggccctccaccgccgacttgtggatgcaagggcggctgttgcgaagatcatggggcagttgggcaaggtaactgatgcgcttttagccgacgagagtggcgccgcccctctggcgtttgtccgcaaggcaagggagttggaatcacagcttagagatgctgaacaaaacgtttcaacgttggagtatgaggtgagctcaatatccgctggggctgctcaaccagcccatgctgagagatgggcggatctgtctgcccaagtggaagcgggagattacggagcaagagaaagtgtcaggcagctggttatggacacattcagtcgaatcgttattttcatgcggggtgtggacgcaaccgaccgcgaaggtccgttcattgatgtgcaactgttctcgcgcacgggacagcaccgggtgcttcggatccatcggaaaacaggtaactgggtagcgagtgaggactgggattaggccaaatattggctaggctgtatttcctatatactgtctggatatacagcagtagcaggatgcttttgtgcttcagcaaaatcgcttttttccaatgcagccgtccaccccgttcgatcaacttgcatgccgtatttaccgacaggtcaacagcgcctccgcccaggtgctgcggcggacgttaatacggcgactatccggcgagcgctccgatgactgggatcgacttctagagcaattgaataacgaggaaagcgtgcgcttgaagcatttgggggacggtgttgcgcaattgagttggaccaaccatcaccccttttgattactcagcggctaataaaaatgaaaaaatatgccgcagatgtttgacataaaattagcctgaggctaatttatctccatcagttcagggtgttgcgctgcggtgccctgatcgctttggaggtttacatgacgtacaccctttgcctttcgccggatgcgcgctctcagttatcagaccaggtcactcagaacggcaccttttcgcaccttttttttgcagaagacggacgctgctgcgcgacggccactgttgccattgagcaaggctcagaagctgtatctgttcaggtcagactgggtagcactgtaaacagtctgaccatcccaaaaactgatcacgttgccgaacgaactgcgtgccttctcgaggagcttgttctttgcaacgatccacgattcacgccagacgccgatgggcagttgaccatttccatcctggagccaaatgcgaagcgactgttcggtcaaagcattgagggatatcggagtgcaaacgcggaactcgatgccgcaattgcaaaagaaaactggagcgcgatacacacagcccagagtcgccgtgatctgcacgccagtactatcgctttgatcgtgaacaagtgctctgtaggtattgaagtaggggtaaaaccatgatcgggatccccaagacaggcacgctggaggtcagccgtatcagtgctaatgtcagcagcggttatcaattcagcacagccgatgggcgtcctgcacgtctagcgatcatcgatgaccagggcaatgtggtagaagccggcgatgctgttgcccgcgaggcgtggaatgtgtgtatcgctgtgatgaagaacttcaagattggccaaggtcatatcgtagtgcacagtgccccgcccggattagctaaaggtaatgcaggcaagctatgtccacgtaaggctagaggatgagctgcgaagctgatcggaacgttttaaggcacgccgactgtttatcaacgacgttacatgccggtgatcttcgcatcgatcgcacggccaattatttcccaagtaccgtctagagctacagccttgtactctggattgagtggcaccaaatagcccaccccagcatctagattgtattgcttgaaggtggtttcgccgctgacggtgtggcgggcgatgtagaacttgccgctgatgaggtcaaagccttcagggcgaatcaatatcggggtgccttccgggaagctaggcggtgtgtccgatgtcatcgactttcccttgaccttcagccaataaccacgtggccctgcattctctgtagacgatagccaatcgtctgcaattccggtcggataacagacggaagattcgatctgctcgccggcggcaacccatgaaatcaatggatattcccgagcctctcggtgaggttgcagcattggggaaatgttggaatggccacttgtagcagccatcccctcgatttcggcagcaaggcgtggactgaagctctcgacgggttcgttcaacagcttcgccagtaccgaggcaaagcgggcattgagcgcatttatccccttcaaataatggttcaccgaaaccggtgttatgcctgcggcatcggcaatcttccgttgattcagcttgagagcgttcttcttagaaagatagagctcgtgagctgcttggcattccgcgaacagggcaggggcgatgggctttttcttagtcattgtcgaagtataagccgctggctaactcagaagattagccgcaggcattgataaaaaatatgttagcggttaatctttcggtcattcatcagtcttaggtgtatgacatggaagagatgtcccttagtgatttagtgcaacggatgggtcaggcgccggtagcgcgtgcgctcggtgtgaaaccggcgtcgatagcgaaagctctaagagctcagcgaaacatcatcgtaacgatcggtgacgacggtacctgcgcagcccgggagacccggccgtttccttgccaggaacactctgcgtcgcccgatggctttaagtccggccacgagaaagcgttggggcagcctaaatgcggtaagcagccttgaccacgtccacacacggacagcagtccatttcccgtgatcaagtacttattgctcatgccgttgagatgatcgcgcgcaccggtttcagccaggacgactttgcccagttactgagcagtaacctgcatcgcatcgttccagacaaggctgctagtaaggacgtgcccgatttcgatgagcttgccaagggcaacgacgcgccggcgtttctgagagcatcgggggcctggctgcgtcgcgttggccgttggcttaacggtgaggtagatttgccgtgctggcttgaagaggcctgggtagaagctcttgacggcgaattcaaagacgattgcatcaacgagcttgccagtcgtcacggtctgactggcgcacgcgagcaggaaggtgacggtaatccgctgtgtgcgttcggcctgctcgtggccaggctgggcgatacagtagctttaggcagcgagatccttgcagacggtcatatcgacctccaagacatcgacaagctacctagctttgtcgataggctccggtcagtcgaagcgcggtgctgtgagcttcgctcgcgtgccgaagacgtgctgctcgagcagcaccagaaacctatcctgcaacaggtgaatacccgcctgtgacttcgccggacaaggacatcaaatcgcgaacgagcgaccgcaaggccggccccagaaagggccgacctactgctgtgcatcgcgacaagaaagatccccacgcggctttgcgagcgcctgctcgcgcacccaggtattccgctccccgccggttgactggccagcagctcaaaaacccattgctgcggatggcgttcaagcgcctgagccaaatcggcgatctgcgcggcacgtacttacgcgatctggacaccatccacggtggccgccgtacacgctccgagaaattcgatgcgctggccaaggtttcagagcagatgctgttgcgcctggatctggccacgggcgttatgggatggctcgacgttgagcgggggcagtttttcctcaacacccagtgcggtgtcgcagaggatagcggcgtctctgctgcgtccttcaatcgcctgctgcacagcatggaacttgccgactatgtttaccggcgcgtcgagaaaattcgcttggatgaaaaggacgaagctggacttaacctggtgcgaactcgtgtcctggtgcgattcactgaaaagttctttgctgacctcggtgtacggtacctctggcatcgggcgaaaaaggccgcactcaagaagcgtgcaaaggagctgcgcgacatcagcgggcttcgcctagcgcgtcaggagaaggcgtccctggaagccttacggcgcgagaagtcacgtaccaactgggaacgtagtgaggcacgcaaggtggctcacagccagggggagatgccagagcaggtcaattcacccggtcgtgttagggcttcccaagcacccgacagtagccctggtggcgtggacgaatctctggcgcgcctgatgcgcagcatccaggtcaagaaagacacctagccccctgaaacgatcgcatcccctgcgaggccaggctacgtctggcagtcgagaaaacaccctatctcagcactcaaccttccgccgtgcatcgccatggcggcaatcggccatgtgtacgtctcctttacagcgcgatttagccgcgccgccggcgcgcaaacggggcaaccagaaagcctttgaattaaatggaattttatacccccttcagcacccccgttgggtataaaaagaggctttcgaggtgtccacagggtcggtgtgttgggtacaagatgatgccttcgcccacgggctcagttcgctgcgctcagctttctatgagaatcgcgggctacgcgcccgcccagcggcagggcagtgccctgcacccggtgctggatacccggcacccagtgccgtggatccagcaggcgtcaaaagcggtaatcgggcgcgccgaggtgcaattgaaattcgcgaacggcggtcgcgggcacgatcgggcggcgcggctgagatttttggggcgaaattgtcagaccaccggccgctgcgcgggttccgccgcgccagagttgtgggtatcaggtgagatcgtgtaggcggcttatatgcctgcgctgcaggcattcgggtgtaggtgttgagagatgtgcagtggggccacgagaacggggaggctgggtcgcgtcggggaggttgcgaacagggtacttgggtcagcctggttgcgaggagccgacctgcaggaacagttcttgctgctgatccgccggcaaacttctgattctctctagaaggattgtgtcgagatgttgggctgggagtctcaaggaatgtttgaatgtaagttcggatacccaagtgtgcccgcacttcgcgtccaggcactggcagtagagcttcacatagccacgagtgatttcctcccgtgaactgatacgtcctttgtagtcgcaggcagtgcagtaaattcgcatgtttccctccccagggttttagagccatcattatgccgtcatctatggtgataatcacctactactgtgtatttagtcagtggtttttgcttctttctctggagtcctccagctaattctcctgtcttcccgcaggctgtcattgacctggttgaacagctggcagatcggccgaatctcgttactggtgtacacgcgatcgatcttttcgatgtcgccaaagccagcgctgttttccgggatgatgccggccaacgcggggttcatgcgccacgcggcgatcacgtcgtttcgggtaatgtttttgaccttctccagctcgtccttggcctgaaaatcccccaccgggatgatctggatggccttctcggcgccgccggggatgttcacgaacatcgatcggaagttgcccacacccttgctcgcgctgatctgatcgcgcagggactcttcgtccttctcgctcaggttcggatcgttggtgtagaagatgtaacccgcgtgcgcgccgttgctgtagtagcggcggcggaatagggtagcggcctcattgagcaacagcgcctgcatgccgcccaggtagtcgggcacgccgtaaatgttctgttccacgtcgtagttcatgacgtgctcgacttcatcctcttcgaactccactttcttgccgtccggcagcagcatcacaaacccgccaccaaccctgacccgcatgttgatagttggcaggtgttccatttccagcacttggccgaacgcattgcgattgcgcagaaagtacgcctcgccaaaaaccatgaaatccaacccggctctgctcatggtctggaccgaaaagccatctgaggcaataaactcacgcagcagcaggttgcgcttgaacccgggaatggcgccgtggtgagcgttggcgcgtagcagtttggccaggccttggcgtgacaccggcggcgtgtaggtctggccgtcgtgggtggcgaacacgcccaggtaatgcccgatgttctcggtcaaaacctgctccggtgcaccgaatgaaaacgcccgcatcggacctggtactggtttttgcggctggtttattgctggtttgcccatgggtgcttggtccgctgagtgtgtagcggctacgccgctgtttgttggtgttgagaggttcgtgggctaaggcgtgcatgatggcccaggcgatatcggcatgaccggaggcgtcagtgcgcgacgcgctgtacgtgacttggccaccgccggtggtgccacgcttgatcgtcaggaaggcctgcgcgatgtcattccagccggcgtcccactcgatcctgctgccctgaatcgtgtcctgcgctttgagcaccaaggtgtttttggtttcgaggctgtagtggatcgaggtcgcacgcgggtaaaaatcgcgcaccaagtcaaacacgccgtaaccgatgccggtggtgtcgatgccgatgtgctgcacgttgaagcgctctgtgagtttcttgacctgctcggcctggtacttgaacgactgcccacgccagctgtgtttctccaggatccggaacttaccgccgtcctctagcggcggggcaatgaccacgcaactggcgtcgtcgcgggtgcgacttgggtcgtagccgatccagacggggctgttgccgaacgggcgcgggtcgtccgggtcgtagtcggtccacaaggacagatcggagtagcagcgttcgagatcgaccagggagaaggcgctctgggtgctgtcgatgaatttgcacatgaacagctgctgaaacttgtcttcgtcgtactccagctgcagctgctcgaggtcgaacagatcgcagccgccggcaatggcgtcgaggattgtgatgaccttgcgccattgcccgtccggacacagcgagccagctgcggcttgggcttcgctcggccacggatccttggcgtttttgcgtttgctgttgcggaatttctcgccggtccagaacgggtatgcctggtgcgatacggcgcttggcgttgaaaagtaggtcttgcgccacttcttgtgggtggccatggcactggcgacggtgtttagtttctcgaagtcgcggatccagaagtactcgtcgacgtagacgtggccatggtgaccttgggcggtgctgctgtttgtgctgagaaagcgcagctcggcccatggcttgccgtccttgctcaggactatcgggttgccggtcagctcgaggccgaaccattcctgtgcgaacgaaacgatgtagctgcggaaaatctcggactgggcgcggctggcagacaggaatatctggttgtcaccggtgagcacggcgtccatgaacgcttcgccggcgaagtaataggtcaggccgacctgacggcttttcaggatgttgcggatccgcgctgtcagcgggttctgtttggcggcgaacagctctttctgatagccgtacatcttgctgatgaacttgtcgagaaagtccacttccgtcagctcgccgacttcgtttttggcctttttctcgcgttttttcccgcccttgtcgctgcgatcgcctctgtcccgacgttcactgcgttgattatctcggcgctggccatcgtccgccggcggatcgccgatcggcgccggtgccggtttcgccgattgcttcaacagccgttcgcgaacggtggtcaatcggtcgagctcgtccagatcagccttggtcagcgacgtggctttgtccaggaggagggtgattcgccggccgacggcggtcagcggttcttcgtccgacagcatgtcgtcccactcgccctggcggatccagtagtaaacgatccggatgttgggcagggacaattgcgcctgaatttcacgcggcttgcagcggcgcagatacaggcgtttggcggcttcttttagttcgggggcgtatggcatggccgcagtctatgcggcgaaaacagtgaaaacgcggggttaaattccgagtttcacctagatcgcggatataggagaaacgcgcaattgaaccgtttgttagagggcgctctgctccatatcttggcagctcaaatcaccgattgagcgcagccaccactcatgccccgttcccttgtttcgttctggaaacgtgtcgccaccagcggcccgaccgtagatggccgcgagatccttccccaggaactgcgcgatatcgctgagacctacaaagctgctacttacacagcggtgatctggtgcgagcacgaacgttggtacggctcccacggcactgtttacgcggtgcgtctggtggaagagggcgacgacctagttccaggtcagatcgctctagaagcgcagttgaagcccaacgacaagctgctttggcttaacgaccaaggcgaaaaactgttcaccagcatcgagatcactcccaacttcgcaaacaccggcaaagcctatctgaccggccttgcggtgactgacgagcccgccagcctcggcacccaagaactctacttctcgaagaagacgagcaagaccgcttatttcgctgcctccctcgagctcggcccgttgcgcgatgaccagccccaaagcgaattgaccaagctactgggcatgttcaccgggctgttcaagcgcttcggtatcgaagaaacccccgcatccccgcaaacccctaccgagagcacaaccccaatggatgaagctacagccaaggcgctgaaagcactgctggagcaattactgctcgttgccgcaggcattcagacagtgatcgagcccgtcactgaagaagtcacggatccgatcgttgacgaagtcgacgatgttcaaaccgctgtttccgacatcgtcgagcaagccgctgccgatcgtgagtttgctcgtaacggcaacaccgataagcgtttggccaacatcgagaagatgctgaacaaggcgttcaacacggttaaaactcgacaggttccacgcactaccggcccagccggcaccaaaacacgggtgctgtgatatgagccaacaatctctgtccaatcgtgctttaaagcagtacgccgctctgcgtgaagcgatcggtgaaacctacagcgtcgacgtcacccgacagttcaacgtcgagccgagcatcgctcaagaactgaacgacaagatcaccgaacgtgccgatttcctcgagcgcatcaacgtcgtgccggtgaccgaaatcaaaggtcagaaggtcatgttcggtgtgaacggtccggtgaccagtcgcaccaacaccaagaccaccgaccgcgaagccaaggacgtttccgacctcaacggtttgggctacgagctctacgcgaccgagtccgatgtaggcctgccgttcgccaagatcgacagctgggcgaaattcccagactttgccgatcgctactcggcggcggtgcagaagcaaattgccctggaccgaatcatgatcggctggcacggcgttaccgccgcgatccagaccgatctcggtacccacccgatgttgcaggacgtcaacaaaggctggctgcaactggcgcgtgagcagattcctgagcaggtgcttcacgaaggcgcagctgacgggaaaatcaccctcggcgccggcggcgattacgaaaacctcgacgccctggtgcacgacaccaagcagatgatcagctcggtgttccgcgatggcggtgacctggtggcgatcgtcggcagtgatctgctcgccgcagacaaggccaaactgtattccagccaggccggtaaacccaccgagaaagagcgcatcgaaagcgcccaggtcattgcgacctacggcggtctgccgaccttcaccgtaccgcacttcccggtcaacgccgtggtcgtcaccagctgggacaacctgtcgatttacttccaggacagcagctggcgccgtcacctcctcgagaacccgaaacgctcccgcgtcgaggattacaacggccgcaacgaaggctacgtgatcgagcagctggagaagttcgcggccgctgaaaacgtggagttgatctgatgagcctggcactggcgcacaagcgccgcgttcaagccgaaggccctgcagctgctgcacgcgccggtgccgaagcggtggtgtattcatccgccaccgcgctgtccagccccgccaacgccaagaaacacctgaagctgatggaagacgcgttggcccaagacctggagcgcgtcagcgcgatcaacagccgcgaactgcgtcagcagctcaagcgtgacgagctgctgcccaagtacgtggactacgtgcagcgctaccgcgattccggattgagtttcccgaactcggtagtgatgcaggtcttggtctggctgttcgacacggtgcagttcgaagtgggcctggacttggccaacttcgccatggcgcaaaaccagccgatgcctgagcggttcaagcgcgacgtgccgacgttcgtggctgatgcggtgttcgagtgggccgaggccgagcagaaggcagggcgcagtccggaaccgtatgtgagcaacttgctaccgcgtgtcgacggcgaatggcaactcactgaacagatcccggccaagtaccacaagttgcttgggattcgcgctctggccgcgagggagtggacgaaagccatctaccactttgaacgcgccactgagctgtacgaggcaattggcgtaggcacacgcctggagggcgctcgcaaagcgcttgcaaaagaactggctacccaagccgccgattaacccgactacccccccggcgagaaactgtggatgtgagccaaccatttatggccatgacccactgaaacagttttcccgcccctattcgagtgcccagcaatgagcttttccgggaaacccaccacctttgtggaacaagcgatcgagaacgacggcttctggccggacctctccgtgaccgagtttcagaagggttaccgcctgccggcggagcacctggtagaaatgctggtcatcaacctggctacggccatgactgaggtcaacagtgacctcgccaagttaaaagcgcgctggcagggcgctggagtgtcacgcgttgaatctgcagacaccaccgtcctgccagagcgcacctttcaagctgagacgtacaaacgcgccgtgtattgccgtgcgaaggccagcttgctgccggagtttgcgtcgatcatccgtcgcgaaagtgccgagaacctgggcaaggaagcccccgaacgcaaggaaaccttccttgagttcagccagcaggccgtccgctcgctgcagggccgtggccgcattacggcggcgctcctgtgatcaagcttcgcgccctgaccgcctacctgatcgagcgacgcctagtcgagcccgagcaactggacagctggaccaaccaggtgaatctcgaactcatctggaagcccgacgtcggcggcatgcgcatgggtgacatgcgctacagcgccacgatcgtgctggagcgtttcgccgatcacccagggcgtttgatggcgttggtgggcagttggctcgggggcaacgaccaggaccgcgacgaactgccggcggcgaagttcgacatcaccatgctcgacaacgacctggccgacgtcgacatcaccctcgaattcatcgagccgcaatacctggccgaggatccggagggcgaaatcgagagttttggtaagacctggtcgttcatcccgtttgacctgtgggtcgctgaacacggcgaggtgtcgagccatggccggtcgtagcacggtcgacctagacatcaggggctatctcggggcgcaggaacaactggccttgctcagcctgccgccaaaactgcgccggcgtttgctgaacaacgtctccaagcgtgtgcgatcgatgagccgcaagcgcgtgcgcgatcagcagaacctggacggctcgcccttcgaggcacgcaaggggtcgagcaagggcaaaaagaagatggaagcgggcttggccaagctgatgcaggtcaccagcgtcaatgccgacgaagccgtgctcggttggaaaaatgccctgaccagttgggtcgcggcgcagcaacacaatggcgtcagtgagcgccgtacggccgctcaaatgaagcggtggaataccgttcccgccggcctggctgccacggaaaagcaagctaagcgcctgcgcaagttgggtttcaaggttcgccaggagggcaagaagtctctgaccagaccgtcagtggcttggattcaagaacacgtcaactacgccagggcggggctactgatccgcatcctggacgacgaaaaaaccgagagcagcggcgcacaaagctgggagatcaccttgcccaagcgccaattcatcggcgtcggcaccgaaggcgataccgcctcgctgctgagccaggtgctcgaacaaatccttaattcaccccgctagcgaggcactgcatggcactcggcaaagtcagcgttaacaacctcaatctcggccagggtgccgtgactgagatcgaacgctatttccttttcatcggcaccgccccgaaaaacgtcggtcagttgctcgcactcaacaccgacagcgacctcgacggttcgctgggtattccggccagtgatctgaagacccaaatcacggcagcacgtctcaacggcggcgatcgctgggcgtgcctggcggctccgatcgcggccgatggtaactggtccgaagcactgaccaacgcgcagcagaaaggcttttccgtcgaggcggtggtgattaccacgccggtggaagctggcaatgaactgtcggtcatgcatgacgcggcgatcggactgaacaacaccttcggccgtcgcgcttttgtcatggcggcaagtgccagcatcactgtgcagcagacctgggcggaatacctgatcgagcagaaggcgatcaccgccgatctggctgcgccgcgtgtcctggtcgtgccgcagttgcacggcaatgacctgggcgtgctggccggccgactggccaacgccgccgtgagcattgccgacagtccgatgcgcgtggcgtctggtgctctgctgggcctgggccccgttcccgtcgacaaggaaggcgtgccgttgccgtccgccattcgcgccgagctggatgccgcacgtttctccgtgtcgcaaacctatgccgattacccgggcgtgttctggggcgacggcaacatgctcgatgcgcctgccagtgactttcaggtggtcgagtacctgcgcctggccgacaaggccgctcgccaagttcgcccgctgctgatccgccgtgtgggtgatcgtcgcttgaacaactcgcccaacagcatggctgccgctatcagcgcattcatgaagccgctgcgccagatggccaagtccaccaccttcgccggcgaggtgttcccgggcgagatcgaatcgccaaaagacggcgacatcgtcctggtgtggcacagcaaaacgaaggttgagatctacatcaagatccgaccgctcaactgcccgaaagacctgacggcgaacatcgccctcgacctttccagcgaagattcggagtaacccttatgtcccgtattggcggtaaaaacttcgacatcaacctgggcgatctgcagatccatgtcgaaagctgcaccctagatatcaccgacaacaccgccgtggcgcaaacccgtggcgtgcccaacggcaccgtcgacggcgatgtgtctgccagtggcgagttcgagttcgacaccaataacttcaacctgctgatcgaggcggcgcgctctgccggcagcttccgccagttggagcctttcgactcggtgtttttcgccaaagcaggcgatgaagagctgcgtatcgaggccttcggctgcaagttgaaagtgtccagcctgctcagtgttgacccgaaaggcggcgagaaaaccaagcacaaggtgccgttcgacgtttccagtccggacttcgtccgcatcaacggcgtgccgtacctggctgcggccgagatcgagggtctgcgctgatgggggactggctcgacgacgctaaggcgatttctgagttggagcgtgagcgctcgatcgcttcccatctcgcgagaccgcgcccaacgggaccgagtcggattcattgcctggattgcgaagaaccgatacccgagcagcgacgtgctgctcccggaattcttcgctgcacaccctgcgaatcttttgccgaaaaaggacagcgccgatgagtgctcgtgccacgccgaaagccaccctagagagtcgccttgctgtgttagatcaccgcgtcagcgaccttgaggaacgtcatgaaacggtccccacgcgtgtcacgcgattggagggcgagtttgaacacatggctgtacagctctcggatctgaataacggccagcgcgagctgaccgccaccgtgtccgatatcggcatcaaggtcactcggatgctagcggtgctgaccgtactgggcgtggtcgcgcagatggtcggtcctgctctgctgcggatcctattcccatgagcctgcgcaacaagatcgccgccggcgccattgtgctggccagcgcgcctttgctcgcgttcctgggcaagtgggaaggcaacggccagaacgtggtgtacgccgataagttggcccgtggtctgcctacggtgtgcaagggcatcacccgttacaccagtccgtatccgctgatcgtcggtgactactggtcgccggcacgctgtgccgaggtggagcagctggtgatcgaaaaaggccaactggctctggctgactgcctgagcaatcaggcgatcggccagaagaccttcgacgccctgagcagccactcgcacaacttcggcgtggccagtacctgcgccagtcgggctgtcggcctgatcaatgccggtcgcatcgccgagggttgcaaggcgttggcttgggcgccggatggcaaaacaccggtgtggtcatcggtcaccgatgcccagggccgcaagcagtttgtacccgggctgcacgctcgccggcgggccgaagcggccatgtgcgcggagggcttgtgatgctgcgcgagatcctgtttccgctgttggtgtgcctgctggcctacatcggattcgacatcctgcaagggcagcgcgacaccgcccgggcagaccgtgatgcagcccagtacgaagccagcggcctgcgtgaagcggcccgaatcagcggggaaatgatcgtcgcccgagacgcgatcgaccgtaaccgtacccaggaactgaacgatgcacgcactgaaatcgatgctttgcgccttgacgttgccgatggccgtcagcggctgcgcgtcaaagccacctgcagcagcaccccgtcaaacgccaccggcgccggcggcgtggctgatgcaagcaccgccgaactcgcagcagacgctcgaccggattatttcaccctcagagatcagcttgccctcagcaagcaaatgatcctgggtctgcaggactacgtcggccaggtgtgcctgcgctgacctgaatcacccctttaacccaaccaccaaaacggacatgaacatgagccagatccaaccccgcgaaatcaccctggaaatcggcgagaaagaattcgccttcaacctaacgccccaggacgtgaccaagtacttcaacgccatgaccgccaacaacaaggtcgcgccgtccttcaacttgctgagcaccaccgtgctgccggcgcagaaggctgatctgcgcgagctgatggttaacccggttaacaccatgcagatcgccggcgcgctgctcgaggagtacgcccctgacatcgggatcatcgtaaaaaagcccttgagcacgctgaccgcctgaccgaggacgggctgggccaactgatggccctgaccaaccgttggctgcctggcgccgagcccaccatcgagaacatgggcacggccaagtggctggaagacgaacactggaagcgcatggaatttgctgtagccaacggcattgcccatgcgctgaacggataggacacacatggccgaccgtagcgcccgcctggatttcatcctggccctgaccgacaaggtcactgcaccgttgggcaaggtgaaaacgggtttttccgaccttgccgagcaaagcgaaaagaacatcaaaacgatgggcatgggcttggccggtgtcacgggggctttcgtcggcatcaacgaatctctgcagcctgcgctggaaatgaaccgcgccctgggcgaggtcaaatccttgggcgtggctgaggacgcgctcacggcgctgaatcaaaaatctctggagttctcggtggcctatggcgagaacgcccgggatttcgtcgcctcggcgtacaccatcgagggcgctatcaagggcctgaccggcaaccagttagccaccttcaccaataccagcaacctgttggccaaggccaccaagtccgacgccgaaacgatgggcgcctatgtgggcaccatgtacaacttgttcaaaggtcaggcggacgccatgggcaagggcgagtgggttgaaaagctgggcgggcagacggccctcgcggttcaactgttccgaaccgacggcgcccaactcaaggacgcgttcaaggaagtgggctcgatcgccaccgccgccggcgtggacatcgccgagcagtttgcggtgatcggctcgctgagcagcaccatggaaggcggcgatgccggcggccgttacaaggcgttcttcgagaacctgggcgccgcctccgaaaagatggggatgaagttcacggactccaacggcaaggcgttgcccatgctgcagatcatggaaaagctgcagggcaaactgggcgacctgaccagcgcgtcggccaacaccaaactgatggaggcgttcggcggggagggtgcgcaggtgatcacgtccctggccaaggacaccgataggctgcgcaacggcatggataagttgggcaaggtgcgcggcctcgaggacgccgagaacatggccaaagccatggtcgacccgtggcaacaatttgctgcagcggtcgaagcgctacgcatcgccttcggccaggcactgatccccatcctgacgccgctgatggccaagctgtccggcattgccggcaccatgacgcgctggactcagatgtttcccaacatcacgcgggtgatcggcatcgtctcgttgacgatcctggctctcatcgccgccatgtccctgctgacgtttgccgtcggtgccggccggatggcgtggatggccatggtgacggtctggaaagtggtgcagctgcttaatctgcgtgccgtggccgggttcattctgcaggtggcggtgatcgcgctgtatgtcgcgggactgaccattctctacaccacgatggggatcattcgcgccgccatgctgctgtggcagggcgcgatctggctggtcaacgttgctctgacggccaaccctatcggcgtagtcgtgatggggatcgccgctctgatcgcgctggtcgccgtcgccatttactactgggatgactggacgtctgcgctgatgaacaccgaggcgttcaagtgggtcagcgcgcagctccaagcactctctgactggttcacgtccatgggcggctggagtggcatggccaaggccgcttgggacggcatcgtcgcgatctttcacaagtcgatcaacagcctgatcgagatgctgaacaagatccccggcgtcgacatcaagacgaagttcggcgccatgcctgaagtgcccggtaccgacatcggcgttaacaacgtggacgcttctgcagccgcgcaaaaagcccagcagaccatcaacgcggccattccaaccctgtcgcctgcgcggcccaacgtagtgccgccgggtggcctgctgaccagcattcagaacaacagcagccagaacaaaggcatgtacgtggagaaagtcgagatccacaacagcaagcctatgactcagctggagatggaaaacatggtgaacatggcggtaccgggatgagcgaatacatcgacctgctgatccacgacaacgacctggtgctcgatccgtcccgccagcccgagttgatcgatgaccgagccagcatcgcccaggacatcgcccacatgatccgcgacagcggcctgctggtgacgctggtggccgagcgcaaccgcctgaaacagcgcgactgcattcagcaactggagctgctggtcgaggcggacgaacgcctcgtaccgggtacggcactgattacccagcttgagcctgggcagttcctggtgacggccacaaccctgaaattcggcaatatcgaggtgacgttgtgagtgacgtggatttcaaacaggccctgtccgatgccggcattccgaccactgaggccggcctgcgccaggcgtgggaagcggaagtgatcgcccaaggcagcaaactgagcaacaccagcacctggtcgccgttctggcgggtggttaccgcgttggtgaccaagccggtgatgtggattctggacttcttgatcagtaccgtactgccgaacttcttcgtcaaaaccgccgtggatgcctggctcgacatgctggcctggggcgtgaacgttgagcgcaagggcgcaaccaaggccaccggttttctgctgttcacccgcgtggcccccggcggcgccctcgaggtcgcaaagggcacggtcgtgcagtcggccgcaatcaatgggcatgtgtatcagctggtgaccacagcgatcggcacctttaccgatggcgtgatgcagtcgctggtaccggttgaagcggtcgacgtcggcagtggtttcaacttggcgcctggctactacgccgtgttgccggtaccgattcccggcattgcccaggtcgtcaacgcggacggctggttgaccacgcctggggccgatcgggagcccaacgacgaactgcgtctgcgggtgcgcaaccaattctcggcagtcaaccagtggcacaccgacgcggtgtatcgggcgatgatttccgccttcccgggcgtgcgtccggacggcgtgtatttcgaacatggcgccccgcgtggacccggcagtgccaatgcctttgtgttgttcgatgctgacgtgccggcggcaacgtacctggcgcaaatcaacgcccatatccgcgacctgggcaaccatggtcacggcgacgacctgctggtgatggtcatgcccgaaactcagcacgacctgcgcgtgacactctggccgcgctcgacgttgaccggtgcacagcgtcaaaccctgcaggacgaaaccgccttgttcatccgtgcggccttccgtgagagcacgtcgggcgactaccagccgacgctgacttatccgcagtcgcgcttttccttcagccggctgggtgaagaactgcaccagcagtttcccggcatcgagtcgctgcacttcgacaacgacgacatcctttcggaactcaacatcccccggattcagagcctgcaggtgctgagcaatgattaagctcgatctgaagttctggctggccggtaccgagctgaccaagctcaaggatgcggcccagggctggtgggaaaaggtcgagggttggctgcgctggcccttgctgcagatggatgctgatacctgccatctgactgtgctcgatctgctggcctggcagcgcgatatcacccgcttcaagggtgaacccgagaccctttaccgcctgcgtgtgaagtacgcctttatcaacgcggtggacgccggcagcaccgccggcatgaaacgcattctgcagcgcctcggtgtcggttacgtcgagatcgaggagcgcatgcccgaccgagattgggacgtggtgctgctgcgtttctctgacacccaactgtcgcaaaaccccgagctgctgcgtgtgctgattcaacagtacgggcgcacgtgccgccgttatgacttcgtgaccattaccccggtgccgttctacatcgccgtggtcgacttcaacgatgaccagcaaacgctggttgcaagcctttaggagccctcatgggagccagcattacccttgcgggcgaaagcctgattgcgcagaaacacgcagcccaactgggccttgatgtgtcgcggttcatctttgccaacgttccagggcttgacccgaatggcccggtcgatcgcgcagcgcccaaacctgctgccgggcaaatcgtccacgtctacgacatcccggacgacaacgccggctatgtgaatcccaaccaggtcgtgtacagctcgcagatcggctctgacattggcgactgggatttcaactggatcggcctggagacggccgagggtgtgctatttgccgtggcctacgtaccgctgcagatcaagcgccgcaacatcccgccgttgcaggtcggcaacaacctcacgcgcaacttcctggtggccttcgacggcgcccaggcgctgaccggtatcaccatcgatgccagaacttggcagcacgactttaccgtgcgcctggccggcatcgatgagcgcgagcgattgagcaaccgcgacgtcttcgggcggtcgtgctttttcggcagctcgctgcaagtggaaaaggtcggcagtgtgtaccaggtcaaaccgggcaccgcttacgtcgagggtattcgtctggagcgcacggccgtactgccgattgtgccgccggcgtttcccaccacggcctggctcgacgtcgcactgcagcgcgaattgagcgacgtcgtcgccagctggcaagtggtgttcggcgttgataaacccgactacaccgacagcgccggtgtgcgtcattactgcgttgcgctcgcggacctgaccaactccaataccctgatcgatcgccgatctgtcgaggcgatcggcgggccattggtgactcactttgccgctcgtaacggcgactacgcacaactacgtgcccgatcgaccaccaaggaggacgtcgggctggggaacctgcccaacgccaaaagcgacgatccggaaacggacagcagcgtcattctggcgaccactaaagcggtgaaattcgccattgatttcgtggtgggaaagttggtgcaagccaccgaaacggtgaagggcattgccaaggtcgccacgcaaactcaaatcaatgcgggaaccgatgacgcatcttttatcaccccgaaaaagctgcgtctgggcttttccatcagcttggcacccaatggctacatcgtgttcccgacgtggctcggaggcgcaatcatccaatggatgtacacctcgaacagcaacaaccttggttctggttactcccggtcgccgtatccaatggcatttccaaatgcctgcctggcggcgtcaaaaatcaatctggcaacgggttcgggtggctacgtcactgtcgacacgagttacacgtacttgggaaataacgccattgattggattggctacatgaacaacaacgaagtggccagcaacgtggccaccgtcggggttattttctttttgatcgggcactgaggaacatcaccatgcaacgtttttacagtgcaagcaccggcaccacgtacctgtcgtctattcacaccactatgcccgctgatgcgaagcccattagcgacgagcgctatttgcaggtgatcgccaatcctgctccgcagaaagtgcgcggccatgatcttgacggtttgccgatcttgattgacccgccgcagctcgatgccgacgcgcaccttgtagagcgtcatgccgcgcttttcgccgcgatcaatacggcgtgcgaacttgaaatcacctcggggtttgactcggctgccttgggcgctcgatacgtttacagcagccaactggaggatcagctcaatctgaccggtgttgtgttgttgaacgtcgacagtgcgtatccgtgcagcgacgaacagggttccaaagcttttcgcgttcatacccgggcgcagctacgccaggtcagtgacgacttcaccgtgttcaagctgcagttgctgcagaaggccaacgaactgaaacagcaggtggatcaggcgctggcggccggtgatctggccggcctcgaggcagtgagctgggagggcgtgcagccatgaactgggcaccggtgaccatgcgctggccagagcaggccacgcaatgggtggatggattgggcgcggctcaggatctggccggcggtgagttgaccagcaccgcgttacgcttggcgagccttgacggtttgaccagtaccaacccggggccggtcggtgacgccgcgaaagaagcgatcgccgccggccgtgccgcgatggcggggcagttcggtgaggcgcctgcttgcctggtggtgacaccgttccagagcggcatcggccagggacgcggcaatcagcgttttctctctgcgccgaatctgctgcagcagctggcgggcaaactgatcgacggcactgacactggacgcccgactgggccgcagtacgcgctgtcagtattgttcctgggcacgaactacgaccagctcgccagcacgttgtcgcgcttcaacgccttgctgccgattcctgacctggtgcgcaccgagcgtcgtgccgcacacctgtcgacgctggagacggataagtgggagattccgagttctggcccgctaccgcgttggcaagcgctgccgctcgagcgctgtacgttggtcaaggccgcgaagcaatcgatgtccggccaactggcggtgctggagagctacgcggccgatagctcgccgatgggcgatctggccgcgctggctacgcgcaaggccgctcagcagcagagccgcgatcagcaactaaacgacctcaaggctttgttggtcggcggatccgctgacaccagcatgcgcgcacggctgatcggtccgggggatgtcaacgaactgcgtcgctcgttgctcgagggcgaagcaccaggtcatgagtgggtgctgtccgccggcgtgctgctggtggggtcgctggaaggattgagcttcgtgcgggagctggtcggcctatgacgctattactcgacggcgagcaggtcctgggcaagcggatgaagatcaccgccaacctgcgcatagaagccgatgacctgtctggccaaaccagcaacacagagacagcccacaagggcttcaagccgaaaaccctagcggtgtcgctgatgatccccttcgttgatgcggtgcagatgcgcacgatcatgcgtctggccgaggccacggccggcggtggccagctcaagatgtaccggatcgtcaacgataccgccgcagcgttcggcattcgtgaggtgcagttttcggacggcgtcagcgcccgggaagacgacacgctggccgcttggctggtccagttcacactgtcggaaaaagcctcgaaccccgagaaggtagaacagcgacgggcagcaaacggcgtcagcgctcagtcagcacctggtcaggcggtcggcggcgcggccggtggtggaactggaagcgaggcccaagaactgagcggctttgaaaagaccctcaagaagctggacgactacctggcgccgaaaacatgaaactgcataaggttttgacgatcgccggccaggtctacccgctgatcaaggacgaagtgcgcctggatatcaaaagccctggccgcgcgacgttcatggtgcaggccggtgaatccttgaaaggtctggtgacgctggatatcggctacaacgagcgcacgctgcagcgtcacttccttggctacgtcgaacggtcgaccgccgccaacagcacccagcagttggtggcttgccgcgagttttcctcgatcctggccaacccgttgccgctgaacctgcgtcacgtcgacctgcaggcggtgctggccgagatcagcgagaaaaccgggctgggctttcgggttccggacaaggcttatgccaaggtcaaagcgccgtatttctacagtctggcggcgggctatttggcgatggacagtctggccaatgtcttcaacatccccgactgcatctggcagcagcagggcgacggcgaagtgtttgttggcagttggaccgacagcttcttcggtcctcgcgctgcgctgcagctgccggtcgaactgttcgacggttaccagggcaatcaaagcgcgatgatcgcgcccctaccagggcttcgaccaggtgcaaccatcaaccagggcgagcgaatcaccagtgtgactctcgccggcaatcaaatggcgatcaaatggacgacgcaataaagcgcagcgtagcgcgccaatttcctgaattgagcggcggttaccacctgccgcgctttggccgcgtggttgcggtaccggatgcgccggcagcgacgggtttgtgtgacgacttccggccgcgctttggcgtcgacgtcgaagtactgctggccgatggcgagcctgatccggatctgccaatcctcgaaggtctgccattgccggcgccgatgggcgggcaagaagcgggcatgtttggctttccggaggagggcaccaccgtagtgatcagctttgcctacggcctgccacacaagccgtttatcacgcagatcctgccgcacggtctgagcctgccccgggtgccaaagggcgaccaggtatggcagcacagcgaggcctgccagcagcgcgtcgacgccgacggcaactggctgcgccaaaccgatggcaagatccaggacaaggcgatcgaacgcgaggttgaagccctagacaacaccgaggccttccagaatcacaccagaacggtggacgatcattcgaccgagaccgtgggtggcataaagaagattgaggcgctgggcgcgctcaagttgctctcaggtggatccgcgagcttagcggcggtggacgatctgcatcaggccactggccgggacctgaatttggtggtggggcaaaagcacaacgccacggtgggcggcgacatggacgagcgcattcaaggaatgcgcaaaagtgtggcggcggtcaatcagcgcctgcagtcgcctaagacgtggttgggatccgaaggggtgaacgtgctgcaggtgctgtgtgacctgctcgacctggtgcaacagatgaacacgcaactggctgcgcacacccaccaaccggggccagcaccggcgccggttgatgcagcggcgttcgccgctaaatcagcgtctgccttgcagctttctataaagttgaaagctgtaacgttgtaaagcttaaaacggaatatctgcatcgtcaggccatggcgtgacgatgtttggtaggttctttggcgtgagtttcatctctagtccaggcagattgttcagccttctccattctaaatgttctgctttcagcagttcttctgtttcagatactttctcttctacgcttttctcgaaatcaaaatctttttcgagttccttgacgagctttattaatctccacgcgctgtagtcatggaaaggatttaatccaatcatatttccaagtaataaatcttttggggcgggagctcttgtgatttttgccagtttgtcgatggctgaatttatgttccagtcagagatgcttagtagtagagagcagaatgcaagtagttcagttgacgctggtgcgtaccttttagttttcgattgtggaataacgtgccttgttgcaaagccgcaaagctcaatggttttctgataatagggttctagcgcggtaacgtcgaagacgtttttaccttgaaatttttctactaattttatagcttccggaattgcaaaggtaactcttttcgaacgcaacgcttcaaggattttgaagctgtcttgggaaaactttgcgatcgttacatggttccagtcaaaccccgggatctcggcgtgggaaggatggtggacgaatgtgtcatagttgactgttcgcataaggcggttgaggtatatgaatggcttatcagatactgtcagcagataactacctgaggtttttgtgtcaaagtaccattggcgcattgatctcatgtctgactgactgaagattcccgattcaattgctttgcaaacgaatgtccttattagcttttgctcattggttcttggtttatcaaactttgtgtccccgcctagtctcggggtgtcgtcgcttgagttcgcaaactcacaaaactcgcgatgtgcgtctacactgttttcgcgaataaatcgaaagtgggcttgtcttaagggtgtcttatcttctttcgagctagcgccacttactagaacggcacccacaacgccacatgatggacaaactgcgtctcgatgaacgaagcttctgacgtcatcaggtatgttttttagtatttcgactgacgtttctattggtacattcttgtacaatgcaatgagttgattagtatccagctctttctcgtaagttttagagtaagcggtcatcggcatggtggattccaaataggtcgaaatgagatttggattatcaggttagcagccgattggcttcgttgtcttactattaatagttgatcctattcaaggcgacaccaccaggattgggcgtaggcacacccatcaatgtactcgatgccgcttaagacaaaaccggtcacagccatcccagccagcgttgcgtctagcaaccgtggtaaaggatcgggatcgagaggcatacccacttcaacacgggctacattggcgctccgccccaactcggcattgttctccgagttcaccatcacattgccctttatcgcccgatagcgtcgccgttcctgtggcgtcagcgcaacgcctctgcacctcattggcgtgatcaacatatgcatgcgctagcccacctatttgccaagctctcgatcaaaaagggcttcgaccgcataggccagagcgccatcggcttgctccagaagatcgcttagatcgtcacggtcgattatctgattccggtgtaacgcataggcctgtgtcagcagggctttgtgatgagagcccgggttttctaacaaagcgacttcatcacgcagcagtgcgtgccacagcgcgacagcggtggctccgttgaccgacctttcagaatgttcttcgctcatcgctggctccagccgattactgtatgtatgaacagtatatccatggagcgccgtcacgctatggcgggccgatgaaatgtcggtcaatgccaatcaggtcagggcgccggccaaaacaggtggatgaagaaaaaaactcgcgaaaaagcacttatccccctcccgccgacggggtttacgtccgttttttatgcaaatcgagatgtagtgcaaacgatcctgtagcgcaggagggccgtggggcttcacgggtgatctgtcatttcattttttgaaaggttttgcaaagaaatgcagtggcgctgcacagcggcattagacagcccacgaacatggtaagactaaagccccccatttcattatccgaaaacccttaaaacaggggtttcgttccatttttgaaaaatacgaacgatcttcttggcccgtagtttcctctgtgctggagggagctgaatgccctgaactgccggtagcacggggcttcgcggctgattccagcttttcacagtctgaccaagaattcgtaggaggggggcgatgaacgtgggtggaaaaacggacgtgccacgggcttttccctctaactctcactttaaactccgaccggaaattattttcacgcttgggcagggggactttcacggtgttggttctcggaggaacatggttggcacctgatgcgcacagctttgggagacggatctaccaattggccctcaatacggttccctactgactgcagttatgtaaagcctcgctagggacttttagggagggaagaatctaaccctcgttatcagcttgggaagcccaaaacttctctggacttcctagtaagagccgactacttcttggtgacaggcttcagtcttttcccccttgacagcgggggagggcttcccaggatgtcctcaaatgcactttcttttgagctttcagctgcaatgatatttcgggagtattcaatttctttgaacacgtcctgttcaacctctcttagttcgaatctaaggaggtctagattgagaacattaaataggtcgcgcagcttgattttctgcgacttctccgatcccttatgttcagttatataacccgatagcttaaacgcttcttcgatttcagagttgtgagcattgtgtatcatatccatcgtagcattaagcagcgctgaaagaattcgctcttctaattcattttgacctgttcgcgaaatcgaccaagacaccaggctttttttgtgaaccccaacttcgatattaaattttaggctctcagtgtagtctctcagcacctggtcgtcagaactactgagaatctcaaaaatttcagcgtgtgcgtctaccatacttttcagatagtaattttcagcataccgaggctggtcgattacctttagaaagcttaatacttgctgccatcgtctgtatttgctggcagcggctgaatagaaaactactgctcggatgtccggtaaatctttgacaaatgcggctgcgtggtaatctaaaatacttttatgtaggaaggttgttaagtctagtccttcttcaataagtaagcatgaaactttaattatgtcatgcctaaagcagtcgatatcacacttgcattctggcgcatatttcaatgcatgatcgaacgctctgttgaactgtgagcggttcagagagcgacctccaccagcctgtacagccatgaagcagaatgcatcaaacagctgccgcagttggcgttctggcaatccactgtgatgctgcctgttaaagcccgctttcaatttgtcatgttttgtaaatacaattccaaaaagtttatcaaagaactcatctagacttagcgggatttctttttctgtttgataaactactatgaccaaagtgagcattaatggagtagaaataatgcccttaatgtcaggcgggcatgagtgaagcgcactaactacatcgattcgtttgtcggcggatgggatcagcttttttacaaaaggatcataatcatctgtgtcgagtggtaccagacgtaatactctgaagcctactaagttttgtatgctgctctgcggtcgactagatactataatttgcagctcagggaatctagtttgcagcgaatctaggtcgacgatagtatctgtgacgcattcctctggtatttcatcaaatccatcgaggagcataattatttttcctgacgcggctaagtgacaaaaaacttcatctccgccaggaatcccaacgaccttcagatagttttctattattgcctgaagggttcgtttcggtgatatgtttctcaattcaagaaacattggtatttgattaatcgcctctgtattcaaaagcgagcaggccagatgcctcataaagatggatttaccttggcctacaattccctcaattacaagattgccctccggtaactcttgaatggaatctattgtaattacttcgtcatctatgccaattttagacggatagtagaactttttaagcgagacctcatcctcggctgaccaaatcgttttaaccttgtcgattttcatcagtgtggtggcaagctttttggtgcctgcggcagtcgcaagcttgtccaaggtctgcttgacctgtcctttagcgcccacgtagagatccttaaatgctggagcaagtaatcgcgaaagcaacgtaatagtcaatacggtggcagacatgctatctccttatagtgtcactaaatcaaaggctactcgtgaggcgcactgacgcttccggtgacagccatggtgggcggatccgagccagatgcgtcgttaccaagaattgaatgctttaaagctaacctcacccggctgaggatcgtagcttattacgtacgttatttcgcgtcgcttgaaaaaagggcttgtattgatagtgaaggcttcactttgaggctggacgccctgacaaagcccccaagtgattgcaggcatgataatgcaccgctggatgctctgaaggagtggggcgggtgaaggggatccaaccctcgatatcagcttgggaggctcccttgatgcactggtgtcatatgtatattttaaatatcactagggcaacccagagatacaaagccaacctttggattggccggcgcaggagtggtggacatgtctaacctcggtattttgtgacatcgctttctgggtgcgaaagccgacggacgggcgcttagggcgcgcctctgatcaaaaagtgcgcaattctagcggcgagcaacgcacttgaccagctttatgcagggaaatacgacgagtgctgcgctatgcttcgcgccgttgagctttaccaattttttacagtcaacaaaacgtctgtaacaacaggtaaaacagcgcatgctgcaccacaaagcatagtgcttcattcaaagaagccggttctaaaatcaggagtgttggatgggtcaggcaagtagtcatgcggcaggcgccgagggttcggcctccaagccgctgagcatgctggtcgcggcggtcggggtagtttacggcgacatcggcacgagcccgttgtacaccctcaaagaagtgttttccggcggttacggcgtaccggtcaaccacgacggcgtgctgggcattctgtcgttgatcttctggtcgctgatctgggtcgtgtcgatcaaatacatgatgttcgtgctgcgcgccgacaatcagggcgagggcggcatcatggcgctcaccgcactggcccgtcgcgctgccgggcatcgcaagaaattgcgctcgttgctggtggtttgcggactgatcggcgcggcgctgttttatggcgacagcatgatcaccccggcgatttccgtactgtcggcgattgaaggtctggggctggcatttgatggcatcgaccattgggtcgtgccgctgtcgctggtggtgctggtcgcgctgtttctgatccagaaacacggtacggcgcggatcggcattctgttcgggccgatcatggtcacctggttcctcgtcctcggcgccctcggtgtgtatggcatcagccacgcgccagaagtgctgcatgcgatgaacccgatctgggcggtgaatttcttcgtggttcatccgggcatgggcgtggcgattctcggcgctgtggtgctggcgctgaccggtgccgaagcgctgtacgccgacatgggtcactttggccgcaagccgattgcccgtgcgtggttcattctggtgttgccggcgctggtgctcaattacttcggtcagggcgccttgctgctggaaaatcccgaggcggcgcgtaacccgttctatctgctggcaccgagctgggcattgattccactggtcggcttgtcgacgctggccacggtgattgcctcgcaagcggtgatttccggcgcgttctccctgacccgtcaggcgatccagctcggctacatcccgcgcatgtacatccagcacacctccagcgacgagcagggccagatctatatcggcgcggtgaactgggcgctgatggtcggcgtggtgctgctggtgctgggctttgaatcctccggcgcactggcctcggcctacggcgtggcggtgaccggcaccatgctgatgaccaccattctggtgtcggcagtgatgctgctgctgtggaaatggccaccgatcctcgcggtgccggtgctgctgggctttctgctggtggacggtctgtatttcgccgccaacgtgccgaagatcgtccagggcggtgcattcccggtgatcgccggtattgcgctgttcgtgctgatgaccacctggaagcgcggcaaacaactgctggtcgaacgcctcgatgaaggtgcattgccgctgccgatctttatcagcagcatccgcgtgcagccaccgcatcgggtgcagggcacagccgtgtttctcactgcacgctccgacgccgtgccgcatgcgctgttgcacaacctgctgcataaccaggtgttgcacgagcaggtggtgttgctgacggtggtctacgaagacatcccgcgcgtaccgccatcgcggcgcttcgaggtcgaagcgcacggggagggtttcttccgggtgatcctgcacttcggcttcaccgatgaaccggacgtgccgcaggcgctgaagctgtgtcatctggatgatctggatttcagcccgatgcgcacgacttacttcctcagccgcgaaacggtgattgcttcgaaacttgaggggatggcgcgttggcgtgaagcgctgtttgcgttcatgttgaagaatgccaatgggaatttgcggttcttcaatctgccgctgaatcgggtgattgagttggggacgcaggtagaaatgtaagcttggcccctaccgaaaagcccccgtcagccttgtggttggcgggggcttttttgtgggcgtctggtcgggcgggtatttggtcggtggctggaaacaggaagttgcactgtgtttaattcaacgcaatactctgtgcattattgtgctaatcagcaagtgagtgagaggtagttatgacggcattactagaacgtgctgaccaggcaatttccgtcactgccatggtcaggagcttcagtgcgaagctcaaggaaatctccagtcgtgcaactgagcgtttggttatcttcaaagacaatcaaccggccgctgtcatcatcaatgtgcaggcctatcaagagatgctggatgaactcgagaatctgcgcatcgaagcggcagcccgggagagattgatcaattttgatccggcccaggcggtcagccatgacgatatgcgggccaggtatgccaagaaggactaaaggagtgctggatggtttggggagtgatttatcatccggaagtccaaggggatctggatcaacagggatctgcggcagccaaccgggttcttgatgtcattgaagagcggattattaatggtgagccagacaagtctggaaaaccgctcagagccagccttgccggatgtcgcaggattcgcacgggcgacacgcgcattgtttatcgggtcaatggcagggcgattcaggtgttgatcgtcgcagttggggtgcggcgagatgaagaggtttacgacgccgccgagcgtcgaatctgatcaatgtgtcgaaaccaattaaaagatagtcctcgccggtttttcaactggcgggggcttttttgtgcctgcgcttttacatgctcttgggtgcatctaattcagattcagcctttgttcgcggaggacgaggagtcagtgtctgaatcacatcatcaagcaaagccttgcccatgagtgtgaggtaatgcgcagcccaggcgtggcggtcggtgtctctgatgaaggccgcatcttcggcgaaggattttacgaggtacagcaggtcggaggatttggacagggcatcgagaatcgggatgccggcgctcacgttgaagaacgcttgatccgagttgtagaggaaaggggtgaagccgatggttttaacggttgcgagtccgtgcagatcagtttcggtcatcgtgttactccttagttcgaagtgccgcgactttcgttaccacgcgaaagggaggcaactgtacgcagggtggtaaaccgggaaccaaggaaaccggcacgcccgaaagcgtcccacgcacagccgccataacttgaggagcgcgctgttgcgatggtttctccgggttaccacacccgatcgctgaatgggtcagcgacgtccggagagtatcccgtcgaaaaacagcgcaatagagcggcacagcgccccaacaagagtttcggagtttgcctacaaggtctgtgggcgtcatctgatattgcgagaccagaagtaaacgaaactaaacgttgctggcggttttgcggggatttgttcagcagatgaatgagtgtgaagttgacgatcgataatgccaatcaagcaggtgtccacgttttatggaatgtggacacttggcgtttttagcttcctgaagagtcaagaaatttacggtcactgcacaaaatctcgaatccagcgccatcccttgtaggagtgagcctgctcgcgatagcggtgtgtcagttggcaaccaggtggctgacactccgctatcgcgagcaggctcactcctacaggggaatgggttcatcgtccgagatgtaaaaagcccccgcaactgtgaagttgcgggggcttttgggggcacggctcagatcactcttcggcgaccgagtccttgctttgacgcttctcgatcaagtccaccaaacgcttggccagcgccgggtagttctcgtcgaagtggtggccgccaggcagtttcactgcctcgccaacggcagtcttgtcggtgcagccactttcatcggtctcttcttcaccgtagatgcacaccactttggccgctggcagcttggccatttccgggccggtcgcggcttctttgcccgcgttgcccagccagccttcaacttcgatttcgaagctgccagtgcgggcgaaggccagcaggatgatggcgtcgacgcgttgctgctcggtgtccggcaggcggttgtagatcgctggcaatacgtcagcaccgaacgaataaccggtgaggatgaaacgcttggtgccccatttctgccggtagtgctgcatcagctcggtcaggtcgagtgcgctttgctccgggctcttgtgttgccagtagtagcgcagggtgtcgatgccgaccactgggtagccgatcttggccatttcaccggccacgtcgcggtcgagatcgcgccagccgccgtcgccggagaggaacagggtcacggtgtctttggcctggccggccggcacttcaaccaccgggatcgccagaccgccgttggccttgtcgccgccgacgaggatcttgcgcagttcgttgttgagcacttgcggcaggttgatgtcgtagtcgctgatgctggtctcggcgttcggttgatcgcgcacgaaacctgcgctggcgtcgtccgggttgtcgttccacgctgccagccagtggccgtgggcggcggatttcggcagcaggtgcgtgcagccacctttttccagggccagatccacggaaatggcttgggccttgtcgtctttctgctccgacaaccagcgccaggcgagtacagcgcccgggccgatgccgctgacgagagtggccgggccattcagttcacgcagacccgattgcagggcgcggctttgcagcaggcagtctttcggcagaatcacctgaacgatctgcgccgaggcgctgcggctcagggtggtcagttgtttttcagagagtttctggtcgtcgttgaccgcaaccagcacttgagccttgggcttggtgccgggaatgacgcgggtcatggcggcgccatcggctgggttgagctgttcgacggtcggttccggtgccgggcgtttcaggtaccagaaaccgccgccggcaatcacggccagcacaatcagtgcggccaggatgtacttcagggagcgttgaatcatcagcgtttcaccaatccagtcaagccgcccgcgatcagggcagcagtgtcggccagcgccaccagcggatcgagtccggcgggcacggccatataacggggttcccagtcaggctggaacttgtctttgaagcggcgcaagccttggaagttgtacagctgctcaccacggcggaaaaccatcgagcccagacgctgggtcagcggtgcaccacgccggggttgcaaccccgacaacggcaccatgcccaggctgaaacgcgcgtatccgtgactcttatagtgttgaatcaggccgaccatcatgaattccatggtcagcttcggcgcatccgggtgcgcgcgcatcaggtcgagactggccaggtcatggctgtaagtctcgagcaagttggcgaacgccaccgggcggccttcgaagcgaatcaccgcgatgcggaaatgcttcaggtaatcgtcgctgaaacggccgagggagaagcctttctcacgcacgttcttgccggtcagccacgcatcggaaatcactttcagctcgtccatcggcgcctgacccggctcatggatttccagcgacaaaccatcgcgggtgccacggttccaggtgtaacgcaggtccttcatctctttgcccttggcttccaggtcaaagcgaatcaggtcgacccgggcttcttcgccgagtttgatcgcggtcaggccgatgtccatgtagtacggcaggttctccgcgcgcacctggtagaacaccgggcgggcgtggtgaatatcgcagaggtcgcggaattgccagatcatttcggcgcgttgctggccggggccgatcgggtcgtacagcgccaccagactgcggccacggcgtgcgtacatcaggaacgcttcgtcgttctggtgaaacagcagcgccttgtcaccggtcagcgcgaggccaccgtcgggttgcgacgaggccatcagaatctttgccgcgcgatcgagttcgtcaggcgtcggcaagtgaatgaccgggcgcgcggtgcgcagcagccaggtcagcgcgatcaccagcaacagcacggcggcgccgagcagcgagcgcaggccacgcggcgcgtcagcatccagggtgaactgccaccacagttgatggctgtacggtacgtcttgataggcgaacagcagcagccatgtcgatgcacccagcacacagaggctggccaccaggtacaacggcgagaagggcagttcggtcaggcgactcgggcgatagaacgagcgacggaacacaccgagcagcgcagccgtcagtgtcatcagcgtcgcttcttcccagtcgaaacctttgagcagcgagagcagggcgccaaccagcagcagaatggtggtcagcatccacgcggccgacaggcgacgacgcaggccttgagcgagcatcaggcagagcacgccgatcaggctggcgccgaagtgcgaggcgtcgaccagacgatgcgggatcagaaagccgatgtgctccagacgggtgtcgatctcgggagtcgctccggaaaacagcagcaccacaccggacaggaacaccagcaccgccagaatcggtgccgccagaccggacgctgcacgcatggtctgagtctgaaacaggcgctggccttcgttgatcagcaggaatacgcaggcaaccagcagcggcaacaccacgtagatcaggcgatacagcagcagcgccgcggccagtggtgcggcaccgagcttgtcagcgaaagcggccagcagaatcgcttcgaagacaccaacgccacccggtacgtggctgagtacgccggcagccaatgccagcagatacaccagcaggaatgcaccaaacggcggcgcttccggcagcaacagataaaggacggtggcagcagcggcgacgtcgagggcggtaatgatcagttgcaggaacgtcaggcgtcgacccggcaagcgcagcgtgcgacggccaaccctgaccagcaggttgtcgcgcaacggttgttccggcaggcgtcgacggtagatgccgatagccaacactgcgccgagcaacagcacaacagcggcgacagtgccgagcaggccttcggacagccccagcgcctgggaagccgcaggcaggtcactcagcgtcgcgagcgctgccagcggcggcaaggcgcagcccaacgacaggctggcgaacaaggtcatgtgcgcgacttccgacgcccccagacctaagcgtgcatataaacggtagcgcaccgaaccgcctgacagcagcgacagaccgatcgcattgccaatcgcaaacgcggtgaagccgcccagcgccagtgtgcgcggtggcaaggtcacgccggcataacggctggccgaccattcatagcccagcagaataatgaagccgaccacggtcgcgccgaatgcgccgagcagggcgggtttcggcacgtcgagaatcgagtcgtgcagcgcatcgagatcaagttcggcgagcagatggcggcaggcaatcagcgcaatggcaaacagcagcagtgtgaccgccagaccgatcggttgccggtatttgctcaaccgatccagcaagcgcaggcgctcgggtttgatcggatgttccgctgtgacggtgtcttgtggatcagacgagttggcgcgcatcaatcacctcttggattgtgcgcgacaggatggaggtatccagccaagttaccaatccctgtagaaaaaaataatcacaaaatactacgcctctcaccgggtatcggcgagggcagttcctggattgcagaggccttgcctgtgactcaagcatagtcgcaagtcaggacttctgatgatcccaagcggttcactgcacagtgacagatcattgttgcgaaaggactttttcaacagatacaaaaaaggccactctttcgagtagccttttttgatgtttggttgcgggagccggatttgaaccgacgaccttcgggttatgagcccgacgagctaccagactgctccatcccgcgtctgtgtggcggcattctacagacgaacgacggggtgtcaaccgctaatcccataaagggtcaaataagtgtggaatcgcgtcaaacggtcgcaggtgacgcgttaagctgcggaaatgcaaagaattcctgtttggcgctcgcttctctataagaagacgaaattcaaaaaacacacgcgcacaaaaaaggccactctttcgagtagccttttttgatgtttggttgcgggagccggatttgaaccgacgaccttcgggttatgagcccgacgagctaccagactgctccatcccgcgtctgtgtgtcggcattctacagaggaacgccggggtgtcaacccgcaatctggataaaatctgttgaggttcaatcggttagcgatttttgtcgggtgttttttacgttgcagggcaggtggggcaaggctttcagctctattggcgatcgtttgtcgattgagaaaataaattcaaaggccttttcctacgtgcgcaaaagaacattcataccactggtgctatatacaggtgtcagtgagatactgccgatccggttcgccacgtttccttttctgacatgacacagcgaaaaatcatccacatcgactgcgattgtttttacgccgccatcgagatgcgcgatgacccgcgtctggccggcaagcctttggcggtgggtggttcggcggatcggcgaggggtgatcgccacctgcaactatgaagcgcgggcatacggcgtgcgctcggcgatggcgtcggggcatgccttgaagctgtgcccggacctgaccatcgtcaagccgcgcatggacgcttatcgcgaagcctcgaaagagattcatacgatttttgccgattacactgacttgattgagcctttgtcgctggatgaggcgtatctggacgtgtcggacagcgcgcatttcggcggcagtgccacgcgcattgcccaagacatccgtcgccgagtctccaatcaattacacatcactgtgtccgcaggcgtagcgccgaacaagtttctggcgaagatcgccagcgactggaaaaagcccaacggcttgttcgtgatcaccccggatcaggtcgaagacttcgtcagtggtttgccggtgagcaagttgcacggtgttggcaaggtcacggcggacaagctgggcaggctcggcatcgtcgactgctcgcagttgcgcgagtgggacaagttggccctggtgcgtgaattcggcagcttcggtgagcgactgtggagtctggctcgtgggattgatgatcgcttggtgcacaacgacagtcggcgtcagtcaatcagcgtggaaaacacctacgacgttgatctgccggatctgcgcagttgcctggataaattgccggaactgctggaaaccctgaaaacacggatggcacggatcgacagcagttatcggccgggcaagccgttcgtcaaagtgaagtttcatgatttcacccagaccacgctggagcaggccggggcagggcgggatctgggcagttatcagttgatgctgacgcaggcgttcaatcgcggcgggaaaccggtgcggttgctcggggtcggggtgaggctggaggacttgcgcggcgggtttgagcagatggagttgtttgagcggtagtccgttaaaagcaaaagatcgcagcctgcggcagctcctacagagaaatgcgttcccatgtaggagctgccgcaggctgcgatcttttgataggctttaattcggtcctggatccgccaccaagcgcccggcatccttggtcagcgacttgagaaactcagtctgtaactcaggatcgttgcgcgtcagttcgatcaggctttgttccagttcgctggcttcttcttccagacccagttccgacagacgcttgacccggtgtacccactggctcacttcgtcgtcttcgaggtcgtcataaatcagcccgtgcgcttccagcaacttgccacgcagatgactgctgatcatcagcgtcgagtccgagtgcacgtcatccttgctgtcttcgacgctgatctgcaatttgccgacatgattgagatcattttcagcaaagggactgtcgagcagattcaggcgcagcacaccgttgcgatcggtggtcatgtcgaaggtctgtttgccagccttgacctgtaccgggcgctcgctccagggcaggctcgaatactccgtgcgcttgtcgcgctggacttcatcgatgcccgcgaggttttgttgcgcacgaccgttggactgtacgttcatgaacggattgagcccggcaaaaccgtagctcagccagtccttggtcacgctgtccggcaggttgcccaaagcgaaaacgttgaccacattcgcaccgacgccgccgaccacggccactacgcccagcgggatctcgtaggcctcccgccaaggctggtaaggcgtgtagcgatcgtaatgacgggtgacctcgaactcggtgacttcgaaagtcttctgttcgttgatcttcacgcgccgctgcggcagctcaagcgccttaggctcaccgacatcaatctgcaggctgtggtcgagcaacttccgctcgacccgctcttcgtgctcgctgcgttgtgacatgtgattggcacagccgctgaccagcagggcaccgcacagggcggtgcctccgaggcctaaggtgtttcgcttgaacatgacgtctctatctggtttcagcggcggatacgggcctgcaggaaggacaatacgtcagccaccggcaatgcttgcgcttcgccttcggtacgactcttgtattccaggttgccttcggcgaggccgcggtcgctgaccacgatccggtgaggaatgccgatcagttccatgtccgcgaacttgatgcccgggctggttttcttgtcgcgatcgtccagcagcacttcgaagccggccgccgtcaattcggcgtacagtttgtcggtggcttcgcgcacctgctcggtttcataacgcagcggtaccagagcgatctggaacggcgccagggtgtcgctccagatgatgccgttggcgtcgttgttctgctcgatggccgcagccaccacgcgggaaacgccgatgccgtagcaacccatttccagggtcactggcttgccgttctcgcccagtacttcgcacttcattgctttgctgtacttgttgcccagctggaagatgtgcccgacttcgatgccgcgcttgatttccagggtgcctttgccgtccgggcttgggtcgccagcgaccacgttacgcaggtcggccacggtcggaaccggcagatcacgctcccagttcacgccgaagtagtgcttgtcgtcgatgttcgcgccgatgccgaaatcgctcatcagttcgaccgagcggtcgatgatgatcggcagcggcaggttcagcgggccgagggaacctgcgccggcgccaatggcgtcacgcagttcggcgtcggtggccatgaccagcgggttggccacgccaggttgctgggctgccttgatttcgttgagctcgtggtcgccacggatgaccagcgcgatcagcttgccttcttcttcggcgcgcacgatcagggtcttgatggtcttttcaatcggcagattgaatttttccaccagtgccgcgatggttttggtgtctggcgtgtcgaccaggcgcagctcttcggccggcgctggacgcgaagtctcgcgtggcacggcttcggctttttcaatgttcgcggcgtagtcggaaccgttgctgaagacgatgtcgtcttcgccggactcggccagtacgtggaattcgtgcgaaccggcaccaccgatcgaaccgttgtcggcttcaaccggacggaatttcaggcccagacgcgtgaacacgttgcagtaggcttcatgcatgcggtcgtaggtgacttgcagcgacgcctgatctgcgtggaaggagtaagcgtccttcatgatgaattcgcggccgcgcatcaaaccgaagcgtggacggatttcgtcacggaatttggtctggatctggtacaggttgattggcagctgtttgtagctgctcaactcgttgcgcatcagatcggtgatcacttcttcgtgggtcgggcccgcgcagaagtcgcgaccgtggcggtctttgatgcgcagcaactcagggccgtattcttcccagcgccccgattcctgccacagctcggccggttgggtgctcggcatcaacacttccagagagccggcggcgttcatctcttcgcgcacgatggcttcaaccttgcgcatgactcgcaggcccatgggcagccaggtgtaaaggcccgaggcgagtttgcggatcatcccggcgcgcagcatcagctgatggctgatcacgaccgcatcggaaggcgtttctttctgtgtggcgagcaaaaattgactggtgcgcatggttggccgttgtcggttgctatgactggaaatgacggagcagtgtaccggcgagttttgctgacgtacaggcgtgcggccggtgtagaggttcaacagcggaattcctcccgccgttgaggaaacgtcttacgattcttccgcgacaggtgtcggtaccggctcgggcgttggcgtcgggccttcacggcggctctcctggaaccagtgcaatgcgatcagcaccagcgtcggtacgccgagcagcgcggtgatcaggaagaagctgtgatagccgaatttctcgaccagaaccccggaataaccacccatcaaacgtggcagcaagagcatgatcgagctgagcagggcgtattgcgtggccgagaacttcaggttggtcaggctcgacaggtaggcaacgaacgccgaagtcgcgaggcccgagctgaagttgtcgagggaaatggtcaccaccagcatctgcaggtccgggcccatgtcggcgagcatcacgaacagcagattggtagctgccgaagcgacaccaccgataaacagaatcggcagaatgccgaaacgcacgatcagcaggccgcccatgccggcgccgacgagggtcatgatcaggccaaagatcttgctgacactggcgatctgatccttggtgaacccctggtcgatgtagaacacgttggccatcacgcccatcaccgtgtccgacatccgataggtagcgatcaggccaagcagcaatagcgcctgccagcggtaacgcagaatgaagtcgttgaccggtgtcagcactggcgccaggccacggcggcccatggtcgacaggcacagaccggtcagcagcgtatagagaatggcgcgcagaaaggcgcggtcttcgagcagcaggtcgagcggactcatgccgccgaacagcacgctggcgaaatcggtgttgtagagctgggtgaacatcgccggtacggacaccagcagcacgatcagcacgaacaccgacatcaattgatgcatgaaggtgtagcgcccggcctgcagctgagtgcgcagcggcaccggcggctcgcgcatgaacaacgtggtcagcagcgccggcaccatcaatgcaccgaacagcacataggtgccagtccaggccgagtgtttgtaattgaaaccggtagagccgaaaccttcggcgaaaaacaatgcgccggcagttgcgagcagggcggcgacgcggtaaccggacatgtaactggcggcgagggcggcctgacggttgtcttcggcgatttccaggcgataggcgtcgaccgcaatgtcctgggtggcggaggcgaaagcgacgacaacggcaatggcgatcagccaggacagatgtttctgcggatcacagaaccccataccgatcaggccgaggatcaccagcacctgagaaagcaccagccatgaacggcggcggccaagtttgccgagcagcggcaggcgccattggtcgagcaacggtgaccagacccatttgaacgcataagccagaccgatcaggctggcgtagccgatggtttcacgggcgacgcccgcttcacgcagccagactgaaagcgtcgaaaacaccagcatgtacggcaggccggcagcgaaaccgagcaacaacagcacgagcgtcgaaggactggcataggcggcgagcgcggcgcgccaggttttacggggcatgggctgaagtctgcctcaagattgcgaaaacaaagcgcgcactctaaccgctgtgctctaccggacgccagccatggcgctgaatatccacacgattattccggacggtgatgccttccatgcgcaatctggccctttgttcgtcgcccgacgtgctgcccaccggcaggctgatccgcccaccagcgcccagcacgcggtgccagggcaacttggtatcgtcgggcaattgactcaacgtacgaccgacccagcgggcggcgcgccccaacccggccagttcggccaactgaccatagctgacgactttgccctcggggacttgcgcgagggtcgagtagagcgccgtgcgtcggatttgcgcttcgctctcatcttcgtggatcgggtctgtcacgggcgtggttcctgaacttcggcgcagttgtcgctgcgagggtaatgcgtgactgcgcagttgagaaatgaactcaatagaaatagtccggtcagtccttgtcagggtcttattcctacggataatgccgactttttcgcaaacttgagcctttgattcgcttatgttgtccagatccctgctgtgcctagctgttttcagtgcgtccacgcccttgcttgccgacaccgtctggttgaagaacggtgacaagttgagcggcaccattaccgtgttcgatggcggcaagctgttgatccagaccaaatacgctggcgcggtcacgattgactggaaagaggtcaagaccctggacagtgatcagcacttgctggtcaagcaggatgcctacaccggcgaagtgtccaaatcgctgagcgcagcggaagatggcaaggttaccctggccaatggtgaggcgccgaagacggtcgagctggcgagcattcagcagattctcaagcccaaaccggtggtcgaggatctggtctggaagggtaatgtcgacctggcgctggactatcagcgtgccgagaaggataccgacgactatgacgtcggcttcaagaccactgcgcggcatggtcgctggcggcacatcgcggaaggtgaatacaaccgcgaagtgcaggacgatgtaaccaccaccgacaactggcgcgcggaatactcgctggaccgcttcctcactgatcagtggttctggcaggggcgtttgaattacaagcgtgatcacatcgaagagctggcccgccaacgcgtggtgggtaccggtcccggttaccagttctgggacgatgagctgggggcgttctctctcggctcgctgctcaaccgcactgattacgagtatcgcgatggtagcaaggacaacttctactccgtcgccatgaagtgggactacaaccgctacctgattggcaagaaggtcgagttcttcaccaacggtgaagtcggcaagccgttgtctggcgtggctgactacgcactggatgccgagatgggcttgcgctacaaggtcaccgactgggcgtcgctcaatctcaaggcggagcgtgacatcatcagcggcactaacgatgccgatctgaacaagacccgttacaccgcagggtttggcgtggcctggtaaggcaaaagcagagatcgcagccttcggcggctcctaaagaggattgatatacatcctgtaggagctgccgaagactgcgatctttttttgcgcgctgaaaaatagtcgcccacaaaaaagccccgcttttaagggcggggcttttttctaaagaagctacaagttagataacttgtacttcctcagcttgcatgcctttctgaccgcgggtagcgatgaaagaaacctgttggccttctttcaggcttttgaagccgtcggattggatagctttgaagtgaacgaacaggtcgtcaccggattgtggagtgatgaagccgaagcctttttcatcgttgaaccacttaacggtaccggtttggcgattagacatggtgtaactccttgaacaaagataactgcgactcaggaagaaccctggccgagactgagtgcaaagagcaggaaaaattcttgtagatggttggatcgaaattcaacatatcgtgtagagattctcagtgacacaagcagcacagtggcgccaccttaaccctttttccgagacgtgccaatgcttcttgcgaaggtttcttcgatttagggatcggcggtgtgacggttcgtcgccagaccgcgtaaatcatgggggatcgccgagaattgcagtgcgcactttgaacgaggcggcgcgcccggtaagatgccggacagaatttttccacctcgctattcaggacaccccgccatgagcatcaaatcggacaagtggattcgccgcatggcgcaggaacagggcatgatcgagccgttcgtcgagcgccaggtgcgcggcagcgacgacagccgggtgatctcctacggtgtgtcgagctacggctacgacgtgcgttgcaccaaccatttcaaggtgttcaccaacatcaactcgtcgatcgtcgacccgaaaaacttcgatccgggcagcttcgtcgacgtccacagcgacgtctgcatcattccgccgaactcgttcgccctggccagcaccgtcgaatacttccgcattccacgcaacgtattgaccatttgcctgggcaagagcacttacgcgcgttgcggcatcatcgtcaacgtcacgccgcttgagcctgagtgggaaggtcatgtgaccctggaattttccaacaccaccaacctgccggcgaaaatctacgccaacgaaggcgtggcgcagatgctcttccttgaatccgatgaagaatgtgaagtttcctacaaggatcgcggcggcaagtaccagggccagcgtggcgtgactctgccgcgtacctgattcgtccatccggcggatgtcgggaattctttggcgggcagacactctatggggtgtactgcccgctcttgcttctggcaaaacgggccttcgccgaggagtgctccatgaagatcgatccgcatatcagtgccgagctggcaaggcttgagcccaatcaggttggcgtattagcctggtccctgttggcacaaccatccttgagcatggccggtggaattcccggacagcctgatcccgacacgcccaacgaacagccgaccgaaccgggcgagccgaccctgccggatgagccaccaccggcgccagtggcctgatgcttgtgcttttgtaggagcgaagcttgctcgcgaagcggtctgtctgtttcatcctgggtgaatgggcggacgccttcgtgagcaagctctgctcctgcagggttgaggggcggttcaactgactggccagatttggttatcaccgatgacaaagattttgcagcagtcatccctctcgaccggataaccgccggtaaacgcgccgaacgctggcatcagactgatgcgttcacccaacctgaaacacgccagccgcaaactctggcggcccttgccatgcagccgataaaccggatgcacatgtccggccagcacatgccgttgaggatgtggctcgggctcgtgctgcagggcgaatgggcccaacagtagcggctctggcaccactcgaatgttcagcgccgccggtggatcccctgcgcgtttgtcatgattgccgcgaatcagcgtcatcggcagacccgcgtggcgtgcacgccattccgccaacgcccctaaagtgcccgcagcgtgcgagccggggccatgcaggaagtctccgagaaatatcagttgtcggcagggcagcgttgccagcaatcgatcaatcaccgcgatattgctcgccgtggtgccctgcggaaccggttggccgaggctgcggtaagccgcggctttgccaaaatgcacgtcggctatcagcagcgcctgttgcgccggccagtacagggctttttccggcagcagccaaagctcttccccggccagtcttacgggataaggcgtattcatgggcgtttgcccttgtcggccgatttttccagatccccgaccatccgtctgatccggtcggcgagtttttccgaactcatactttcgcgcatgcgctccaccagcaacggaaagcccaacggcgtaggacgtttgatctgctgcacgtcgagtttcatccgattgatgcgatccagggtctgttccagtcgacgaatatccagctcttcgcgcaggacttcttccccggcctgggcgagcaacaggttgtccgcgtcatattgtttaaatacttcaaagaacagtccgctcgaagcctgcacctgtcgggtgcttttcggcgcgccggggtaaccggcgaacaccagcccggcaattcgcgcgatttcgcgaaaacgccgcaaagcgagttcgccagcattgagacttgccagaacgtcagccaaaagatgcgcagggtcgagcagttcagcgttgagctgcttcgaccaatccaccggcgtggcactgagcagctccagaccgtaatcattcaccgcaatcgagaacgtcaccggttggcgctgactgacgcgccaggcgagcaaactcgccagccccagatgcacctgccgcccggcgaacggatagaggaaaagatgccagccctcgcgggatttcagcacctccgcgagcatattgttaacggtcggcagacccgaccagcgagcctgagtctccagcagcggtcgcagtgcctgcatttccgcgccgatgaactcaccttctgcggccgcactgaagcgtgtcaccacggcttgcgccagttcattggagagcggcatgcgcccgccattccagcgcggcaccgccgcttttttcacgctgctgcgcttgacgtaagcggtcatgttttccacgcgcaccaactccagcaaacgcccggcgaacagaaacccatcgccgggtttgagccgggcgataaaaccttcttcgacgctgcccagctgtttaccgccgccgcccttgctccagaacttcaggttgatgctggcatcgctgacgatggtgcccacgctcatgcggtggcgccgtgccagacgcgcatccggtacacgccagacgccatgttcatccggttcaacccggcggtaatccggataagctgtcagagacattccgccgtggcgtacgaaagccagcgcccacgtccagtccgcaggcgtcagatcacgataagcccaggcgccgcggacttcttcgtacaactcatccggcaaaaatccaccacccagcgccatgctgaccaaatgctggaccagcacatccagcggtttgtgcggtgacaggcgcggttcgatgcgccgttgctcgactgcatcgcgggcagcaacggcttcgatcaattcaaggctgtgggtcggcaccagcgtcacccgagaggtacgcccgggtgcatggcccgaacgcccggcgcgctgcatcagacgtgcgacacctttggccgaaccgatttgcagcacgcgctcgaccggcagaaagtccacgcccagatccaggctcgaggtgcagaccacggctttcaacaggccatccttcaaggctttctcgacccagtcgcgggtgtcgcgagacagagagctgtgatgcagcgcgatcaatccagcccagtccggccgcgcttcaagcaacgcctgataccagatctccgactgcgcccgggtgttggtgaagaccagcgtgctaacgcaggcgtcgagttcggcaacgacctggggcagcatcttcagaccgatgtgcccagcccacggaaagcgttcaatggacggcgggataagggtgtcgactttcagcgatttttcgctttgcccttgaacactgatgccatcgccctgtgggatcagtacttcctcggcgtgggattgattaccgagcgtggcggagacgccccagacaatcagatccggttgccagcgccgcaaacgcgcgagggccagttgcaattgcacaccgcgcttgttgccaagcagttcgtgccattcgtcgacgacgatcatccgcagcgtcgacagcgctacctgcgcatcagcgcgggccagcagcaatgtcaggctttccggtgtggtgatcaacgtggtcggcaggcgtcgactttggcgggcgcgttcgctgctgctggtgtcgccggtgcgcagaccgatgctccacggtatttgcaaatcctcgacaggggcttgcagcgcgcgtgcggtgtcggcggcgagggcgcgcatgggcgtgatccacaacacggtcagtggttcggccggtggtttgcgcttgcgagaggtttcaacgatggcagcgggtttggcgaaacggttgagcgcagcgaaccacaccgcataggttttgccggcaccggtgctggcatggagcaatccggattccccacgtttgaccgccgcccagacttgtttctgaaaagcgaacggcttccagtggcgggcgctgaaccagatttttgcgaggtcgggcgagatgggcatgccggctacgtgcgctcagaagatgttcttccagtgaccatgcagcgctatgacaagtttaatttccatcacttcgcagccgcgagcaaccgcagctatgcgaggtgaaaatcagacttcagaggccgtggtttttccggggacaatggaattgacggtaggcggcaacacgcagttttccggcaccttcagcggtaccgatgaaaatgcaatcctgattgaaaatggcagtttcaagttcgatcatccagcttgaacctgatgcctgaataacagcagccggaaaaccggctgctgctgtttcaaccctgaggctacttcaggttgccactgagaaattgcttcaagcgttcgctcttcgggttacccaatacgtcttcgggcgcaccttcttcttccaccagaccttggtgcaagaacagcacctggctcgacaccttgcgcgcgaagctcatttcgtgggtgaccatgatcatggttcgaccctcttcagccaggccttgaatcaccttcaacacttccccgaccaactccggatcgagcgctgaagtcggttcgtcaaacaacatcacttccggttccatcgccaacgcccgagcgatcgccacgcgctgttgctgaccgccagaaagaaatgccgggtactgatccgccacccgcgccggcaagccgaccttgtccagataacgccgggcacgatcgtcggcttcctgtttgctgcaacccagtacccggcgcggggccatggtgatgttttccagcacggtcatgtggctccacaggttgaaatgctgaaacaccatggccagtcgcgtgcgcaggcgttgcagttcatcggcgtcggcgacatgcatgccgtggcggtcggtgaccatacggatcgcctggccatcgaggctcatggcgccgtcgttgggttgttcgagaaagttgatgcagcgcaaaaaggtgcttttgcccgagccgctggcgccgatcaggctgatcacgtcgccggtcttggccttgagcgaaacgcctttgagcacctgatggtcgccatagcttttgtgcaggccttcaacggtcagtttgtacatgggacagacatcctcaaggcgaaagtaggtagccgctgcggtaggcttcggcgcccgcgacgtgggcgatgaccatgccggccgtggccatgcgtcgcagcgaacgggcatacagcaggccggcggcgacgcaatgaatgggggtgaccttgtcgtggatcgggtcgatgatttcggcgatttgctggccggcttccaggtattgccctgctgtgacgctgtacaccagcaagccgccaaccggcgtggtcaccggttcgacaccggccagcggggtggccggaaacggcaatggcggctgcggtttggtttcgccgacgattgcatcgaactggatcagatagtcgatcagcgcctgacagtcgcggctggccatcggatgattgacgtcaccttggccgcgcaactcgacggtcaccgagaaactgccgaggggaatctcgaaatgttcggcgaagcgttccttcaattgccaccacaacagggtgaaacattcgtcgaacgactggccgccggaatcggtggccagcaagctcgcctgagcctcgatataacgcgccaatggctcgacctgcggccaggcttcaggcgtggtgtaaaggtgcaccaccgattcgaaatcgcagtgcaaatccagcaccatgtcggcatcgcacgccaaccgttgcagggtcaggcgctgggattgcagttgcgtagcggcggtctggcgggcgagggcgtcacgcagatgcgtgcggataagttcaaggttgtgctgcggatcgtcgttcagcctgccctcgatggcgttgccgatttcctcgctgaggtcgacgaaccagcggttgaagttctgtccgctttccagttcgtagcggcccagcggcacatccatcagcacttgttcgaggccgaccgggttggccaccggtacaagcacgatctgactgcgcaggcggccggcagcttccagctccgtcaggcgctgcttgagatgccaggcgacgagcatgcccggcaattcgtcggcatgcagtgaagactggatgtagatcttgcctttggcctgctccgggccaaagtggaagctgtggatctgtcgtgcggtccccggcagcggggccagcaagtcatggatcaggtggcgcatttgctgtgttgtcctagtgagtcgggccgaggaaggccagccatcggcgttcggcaaggcggaacaggccgaccagcgcaaaggtaatggtcaggtagatcagtgcggcgatgccgaacgactgaaaggtcaggaaggtcgccgagttggcgtcccgcgcgactttcaggatgtcggggatagtcgcggtgaaagccactgtggtcgagtgcagcatcaggatcacttcgttgctgtaataaggcaacgaacggcgcagtgccgacggcatgatcacgtaggcatacagcttccagccggtcagtccgtaagccttggccgcttcgacctcgccgtggttcatgctgcggatcgccccggcgaaaatctccgtggtgtaggcgcaggtattgagggcgaacgccagaatcgtgcagttcatcgcatcgcgaaagaaactgtcgagcagcggctgcgcccgcacggcggccaggctgtaaataccggtgtagcaaatcagcaactggatatacaacggcgtgccacggaacaggtaggtgtagaactgcaccggccagcgaatgtagaagtgcggcgagacgcgcgcgatcgacaacgggatcgagacgaggaaaccgataacgattgaggccgtgagcagccacatcgtcatcgccagcccggtgatgttctggccgtcggtataaaggaaggcgcgccagtattcctgcagaagttcgatcatcgcacggcctcccgggcaccggcggcgtagcggcgttcgagccagcgcaggatgaagttcgacgcactggtgatcagcaagtaaataaacgcagctaggaccaggaagtagaacagttgataggtgcttttaccggcgtcctgcgcggctttgaccagatcggccaggccgatgatcgacaccagcgcggtggccttgagcatcaccatccagttgttgccgatgccgggcagggcgaaacgcatcatttgcgggaacaccacaaagcgaaagcgctgaccgcgtttgaggccatacgcggtggcggcttcaacctgaccgcgtggcacggcgaggatcgcgccacggaaggtctcggtgaaatacgcaccataaatgaagcccaaggtcagcaccccggcgctaaacgggtcgatttcgatgtattcccattccagataatcggtcagagacgtcagccaggtttgcaggctgtagaagatcagcagcatcagcaccagatccggcacgccgcgaatcagcgtggtgtagagctgggcgggcaggcgtaccagtttgatttttgacagtttggcactggcgccgagcaggccgagcaacacggccaccagcagcgacaacgccgataatttgatagtcatccaggtgccttccagcaacaaaggaccaaagcccttgaggctgaaggcggcgagccccagattttgcaggagggtttcgaacataaatcagcaacctgagcggatggaaaaggcgcccatcgaggaggggcgccggggcattatttgccgctgtacagattcagatcgccaaagtgtttcttttgaatctcggcgtatttgccgtcatcgtgtaacgctttgatacctttatctaaaagcgccttcagctcagtgttacctttcttaataccgacagcggttttggctggcagcaattcgctgtccactggcttgctgacgtcatagtcggcgccctgtggtgacttcaaaaagcccagttcggcttgcagcatgtcctggataccggcgtcgagacggccggaggtcaggtcggaatacacttgatcctggttctggtaggcctgggttttcacgccggccttgtccaacacggctttggcgtaggcctcttgaatagtgccttgctcgtagccgacggttttgcccttgagggacgcgacgtctgcggtgatgccggaacctttcttgaacacataagcggtcgggccggagaacagttcgctggagaagtcgatgactttttcgcgggccggggtcacggtcatcgacgagatcacaccgtcgaatttgttggccttgaggcccggaatcataccgtcgaagtcactttcgacccacttgcacttgaccttcagttcggcgcagatcgcgttgcccaggtcgatgtcgaagcccaccaggctgccgtcggccgctttcgactcaaacggtgcgtacgaagggtcaacgccaaagcgcagctctttgtattccttggccagcgcggagccagcggccatgcacaacgccagtgcagaaagggtcagcaatgcttttttcattattcaatccctaagaaccaatatgagcgcttgtggcgcagaattattgttactggaacgcgtacgacctatagaaagtagcaatttccgaaccatagtcccgaacaagcgttttaaaaggttggcgcagcgattggatgagcgagtcagtgcccgcaaacgggcactgaaaatagcttgcactgatttagggctgatcgttcccacgctctgcgtgggaatgcagcccgggacgctccgcgtcccatccagagccgaacgcggagcgtccgttgaggcattcccacgcggagcgtaggaacgatcttcgcgtcatgttgaactcaggcgagaagatcctgcaatgtggctaggctatccgcctcatccacggttttatcttgtcgccagcgcagcatccgtggaaaccgcacggcaattccgctcttgtgtcgccgcgaaagggcgatgccctcgaaacccagctcaaacaccaggctcggtttcacgctgctcaccgggccgaatttctccaccgtggtcttgcgcacgatgctgtccacctgacgcatctccgcatcggtcagtcccgaataggccttggcgaacggcaccagcgcccgttggcttgactccggtggcccgtcccacacggcaaaggtgtaatcgctgtagagactggcccgtcgaccatgccctcgttgcgcataaatcaacaccgcatcgacgctgaacggatcgactttccacttccaccagacgcccatgtccttggtgcggccgacgccatacagcgaatcccgcgccttgagcatcatgccttccacccccaaacgccgagaggcctcgcgctgacgggcgaggtcgaaccagtcactgccagtcagcacgggggagggcagcaacaccgggctgttgcagcttgcaatgacctcttcaagttgcgcacgacgtttggcttgcggctggttgcgccagtcttcgccctgccattcgagcaagtcgtaggcgagcaccaccaccggcacgtcttcgaggattttcttgtcgagagtcttgcggccgatgcgttgttgcagcagagcgaagggctgtacggccggtggttcggtcgattgcggatcgaaggcgtcttcagtgcgcggatgcgtgctcttccacacgacgatctcgccatcgatcaccgtgccgtccggcaaaccgtggaccagcacatccagctcggggaagcgctcggtgaccagttcttcgccgcgcgaccacacccacaagcggccctcgcgtttgaccacttgtgcgcggatgccatcccatttccattcaatctgccagtcgctggccgggccgatcagcgcttcaaattcctcaaccggttgcgacaacgcgtgggcgaggaaaaatggatacggctgtccgccgcgctgggcgtgttcgtcggcggattccggggcaatcagtttcaggtaactggcggcgttggggcggttcgacaggtcggtgtaacccaccagccgctgcgccacgcgtttgctgtcaaggccagccattgaggccagcgcgcgggtgacgagcaatttcgacacgccgacgcggaagctgccggtgatcagtttgacgcacaacatcaggcttgatcgatcgagttgtgcccacagcgccggcaattgtcgggaaagaaactccggcgtttcaccacgcagcggcagcagtttgtcctcgatccattcggcgaggccggcttcagaactgtgcgggttttccgggagtaccagcgaaatggtctccgccagatcgccgaccgactgatagctctcctcgaacagccacggttcgaggcccgacatttccacggcaatttcgcgcagaatccgcaccgggaccaattgccgaggccgtccgccggacaaaaagtacaccgcccacgccgcgtcctgcggtgccgccagggcgaagtaagcttgcatcgctgccagtttggcgttgcttgaagtggtggcgtcgagctcggcgtacaactcggcgaaggctttcatgttgaagtctcggcgacggtgggttcggcggcgatgttgtcttcctcgtcatcaccgtattcggtgttaaagccttgcgcatccagaccgttctcgcgcagatgacgcaccagcacaccgatcgaaccgtgcgtgaccatcacccgttcggcaccggtctggttgattgcccacaacaggccaggccagtcggcgtgatcggaaaggacgaagccgcgatcaacaccgcgccgccgccgggtaccgcgcaggcgcatccagccgctggcgaaggcatcgctgaaatcaccgaaacggcgcatccagctactgccaccggccgagggcggggcgatgaccagtgcctcacgcatccgtggatcatttttggcgacgtcaccggcgtagatcgtcggcggcaggtacacgccggcctcgcggtacacccgattcagcggctcgaccgcgccgtggctgaggattggcccgaggctttcgtcaatgccgtggagaatccgctgggccttgccgaacgaatagcagaacaacacgctggctttgccggcggcaatgttcgctgcccaccactgattgatctcggcgaacacctgcgcctgcggctgccagcgatagattggcaggccgaaggtcgattcggtgatgaaggtgtggcagcgcaccggttcgaacggcgcacaggtaccgtccggctcgatcttgtaatcgccggacgcgacccagacttcgccgccatattccaggcgcacctgtgccgagccgagcacgtggccggcagggtgaaaactcaaagtgactccgtgatgggtgaggcgctggccataggcgagggtttgcaggttgatgtcctgccccagtcgtgcgcgcagaatcccttcgctggcgctgctggccagataatgctggttgccggtacgggcgtgatcgccgtgggcatgggtaatgaccgagcgctcgacggggcgccacggatcaatgtagaaatccccggcagggcaatagagaccttcggggcgggcgataacaaggtccatgtcgttaccaggaatggggggcttgttagctatgaggttggcgcgagtccagaagttctatcgactttgaagagcaaccctcaccccagccctctccccgagggagagggggccgaccgaggtgtctggcgctatccatcgacctgaaaaaccgagtcgattatggattcgacacagcaagaaccaagcaaatctcggatctggaaagacacgaaccgatccaattccggattcagcacagcaccttcaggtcggcgcaagtctgcagcaacctccaatcagtcccctctccctccgggagagggctagggtgaggggcttttgatttacaaggccgaccgagatgcccgacgagttgaaccgagcaaattccggattcggcacactccttcaggtcggcgtagacctgcagcaacccccaatcagtcccctctccctccgggagagggctagggtgaggggcttttgacctttgccttatttgccgggagtcagggtcaaacgggttttgccatacacccggtcaaagttctgctgctgcatcggcaaaccaatgtattgccccttcaaccacgcatcaatgccattgagatagttcgggctgagcggattacccgattgccccgtaccgttctgccccatcagcggttcagcctgaccgaagtcgacgataaagcgcatcgacggcgcgcgcgtggtgttgaagtcctgaccccaggcgaaggccgaggtgttcaacgtggtgtggtcgccacccgccgccaatgggccccgcaccgtctgaccattgctgtttttccaggcatagctgtgcaatttgccccactgccaggcgcggtgatcgccgcccaactgactgtcgccagcgctgatcgccgccgcaagactgcgggcaagaatcactgctttgtcttctttctgcggcgtgcgagtgtcgtcccagaacgggctgtcttcacgtcccaacagatgatcggcctgcgccgcgtaggacaaatccccgttggcaataaacgctttccacgccgcgctcgattccggtccgagttcgtcgaggaaaatctgcttcatgctttcctgcaggaacaactcatagatcgccgcatccgccgaggtcgggctgagcttgccgtcgaacgccatcaatcgtgtaaacgcttcacgcgccttgctgcgatccgcttccggcagcgcatcgatggcctgcttcagcggctgcttcatgcctggagcttcaaacacttttttcagcttggcggcgaacgtggtggtctggtcgtattgcatggcgatcacgctgcggctgtcgtgtttgccgctgccggccagttccgccaagcgttcgccacgctccggcgccgcccaggaattcgacaactgcatgccgtaaccgtgaggaatcacgcgctggttggcggtgccgagccagccttgcgccgggtcttgatcgtaggggtgcagcatcgggtcggcgtaaccgtcccagtcgtagcggccttcccagcctggcgatggcagcagaccttcgccttcacgacggttcgggaaacggccagtgacttgccagccaatgttgctcgcgtcggcaaacaccagattcagcgcaatggcgcggatctcgcggctggcgtccgaagcacgttcaacggtttgtgcacgggtcaggtcaaaaaacgcatccagcgacttgtcgtcggtgaagctcggcgtctgcaaggccaggccgaaaccgctgccttgtgcggcggcttgagcactgttgagcaacgggccatgacgggtttcgtacaccgcttcacgaaccggtcgctggcctttgacgaaataggtttcgttgcgcacgcccagcggctgccatttgccattgacctcataggtcaggctgctgccctggcgacggattttttccaggaacaggtcctggttgtcgccgagcacgctggtggtgctccacgccactttgccgttgaagcccccgagcaccagcggcagaccggcgacggtgacgccagcggcctgatatttcggggcgcggatctgcacgaagctccacagcgacggcgcggccagcggcccgtgggcgtcgctggcgagaatgcttttaccgctgcggctgcgttgcggggcgagcgcccagttgttcgaagacgtagcaccgagcatgttcagtgtcgacagttgctggctggcgctgctcaattcagtcaggccgggaatctgcccgttgagtttgagcccttgcagcttgtcggcttcggccagtggcagattctcgtcgggtgcggacggcgtcagccaggcgagtttgtcggtggtcacggtttgcgcgagcaccagcgaggaaatttcttccggcaggttggctgactggctgaaattcagcagggcgaaaatcagcgccgaatcttccggtttccagtattcaggcttgtaaccgctggaggcgaggtcgcccggcaacttgtcggcgtagcggaacaggtaggcattgaccccccgcgcatagacttcgaagaagcgcttgaggcgtggcgacgaagccttgtacagctcaccggcgcttttcttcaggttgaccgcgcgcatgtagcggtcggcatcgagcatcgaggcgccggacatttccgccagacggccctgagccaacaaacgcagggtgaccatctggttgatgcggtcgctggcgtggacgtagccgaggctgaacagcgcgtcgtggaaggtattgctttcgatcagcggcatgcccatggcattgcggcgcaccgacacgttctgcgccaggcccttgagcggttgcacgccggaggtcggcggcagggtgtcctgggcgttccaggtctggcaaccggacaggcccaaaacaccggccactgctgcggcaacgccgaaccggggaagaaaatgagtaagggctggcgaggccatggcaaagctcctgcggggggtagcgtcagtaaagccgctacgttagtgagcaggaggtggccgcgcaagcgggggcgggggttatttgtgtatttctgtcgaatggaaaagatcgcagcctgcggcagctcctacagggacgtgcattccaatgcaggagctgccgcaggctgcgatcttttgatcttcattcaggatttcggcggattgatcttctgcaccagcgcatacgccttcacggtcgccgggcgatccttgatgtggttgaaccagcgctgcacatgcgggaagtcttcaaggttctggctttgccatttgtgcgagacgatccacggatagatcgccatgtcggcaatgctgtattcgctgccggcgacgaagtcgttgttggccaattgtttgtccagcacgccatacagccgcgcggtttcatcaatgtagcgtttgatcgcgtaggggattttctccggcgcaaactggctgaagtgatgattctgcccggccatcggcccgaggccgcccatttgccagaacaaccattgcagggccgtctgccgaccgcgcaggtctttgggcagaaactggccggttttttccgccagatataaaagaatcgccccggattcgaacaccgacaacggctcgccgccatcggccggctcgtgatcgacgatggcggggatgcggttgttcggcgcgatcttcagaaagtgtggctggaactgctcaccctggctgatgttgatcgggtgcacgttgtacggcaggccggcttcttcaaggaacagggaaatcttgtggccgttgggggtggtccagtaatacaggtcgatcatggagaactccaaagcagaaatggacttgcgtgcggacagcaaacgccggcgtcaggtgatcccgtgtgcattcgaaagcttgcctgactggaagaggtaatgctgaactggggcaaattcaatgaccccacatgagaaaaatcgccatggagcttcaggccaacgctgcactgatcatcatcgaccagcaaaaaggcatcctgcagccgcgtttggggcgaagaaacaatcctcaggcgcaagagcgaatccttgatctgttggggctgtggcggcgtagtgcaaggccggtgattcatgtgcagcatctgtcgcgtgagctggattcggtgttctggcccgagcaggaaggggtggaatttcagggcaggtttttgccgcaggatggcgaatggctgattcagaagcaggtgccggatgcgttttgtgccagcggattagaggcgcagttgcgcgaggcgggcatcgggcagttggtcatcgtcggtgtggcgaccaacaactcggtggagtcaacggcgcgtacggcggggaatctggggtttgatgcatgggtggccgaggatgcctgtttcaccttcgacaaggccgattatttcggcacattgcgcacggcggaagaggtgcacgcaatgtcgctggggaatttgcagggggagtatgcgacggtggtcagtgctgcacagattttagcagccgactgaataacttcgccgtttgcaccggccccttcgcgagcaggctcgcttccacaggggatttgcattgcaactgaagatacccgctcgcctgtaggagtgagcctgctcgcgatagcggtgtgtcaggcgccaacgatgttggatgtgcgggcctcatcgcgagcaggctcacttctgcaataattgcattccagctgagggaacgcggtcactgtgggagcgagcttgctcgcgaaagcggtgtgtcaggcgaaacgactgtccgccccgggcatcacgcgccgtggcacttcttgaatttcttgccgttgccgcatgggcaaggatcgttgcggccgacatctttcagggcattgcgcaccggttcctggtgggcgtggccgcagttcgggccgtgcacgtggccgtggtcatgatcgtgatgatggtcatgatcatgatcgtggttgcagtctgggccatggacatgaggttgctgggtcatcggtgttgctccggaattaaatcggcggggattatcacgccattgcgctcaaggtgcacgtagtgggcgatgaataaacctgtttccatttcgccctgcaaacgatagggaatctgctgattcggatttttcagcagtttcaccacgtcttttaccttcggccagaggttggtgcggatcggcactttgaaataggcgctgtgcctgggcccgacggtgaaccagtgttcatgctcgccttcggccagcaacatgtcggccagatgaatgcggtattcgagaccgcgcacggtcaggtcgctgtcattgggattgtcgatgcgaaagtgcaggatgaatttctgttcgagcagcttggcccgcaccacctcgacttttaccaggtgcacggcggggtcgacgctgtcatcgctgaaccacgacgcacaaccgccgaggttgagtaccagcgtaagcatcaagaactgaaatgtgcgcctgcgaccgagcatgtgataactccctttgatgctcagtctagtcctaaaagatcgcagcctgcggcagctcctgcatgagatcgcctacctctgtaggagctgccgcaggctgcgatcttttgatcttaagcgccgaaatacgctgcacagcacttcttgaacttctgcccgctcgcgcacgggcaactgtcattgcgccccagcttcatttgcactgtcggatcaatgaagtaccagcgtccggtgttctgcacgaacgaggagcgctcgcgatggctgtgttcaccctgatcatcgtgccagcgcgcggtgaaggtgacgaaggcgtgttccggctggccgccaaagacctccgaactttctacttcaagaccgagccaggtactttgcgcgctccagttgccgatcgactgcctatccagccccgcttgctgggcgggcagggtagtcgccacaaggtaatcgatcaaacccagcacatacgcgctgtagcgcgaacgcatcagtgcctcggcgcacggcgcaggatggccgtcgtgataatggccgcagcaggcatccagcagattgccgctgccgcaagggcaaatggctgtactcattgcattaccaccagtatttcccgaagttttccggattggcccagaagcgtgaattgagccagtcggggacttgtttgtattcaagcagatcataggtgaacagcgtcagcacttgatcgtcgcgttgaaagcgttcgctggcttgcagcgccagcgaatagaagtcggtttcctgccaaccgctggcggacagatccgccagcaccgcgatgcggctggcattgagattacgaatcccgcccaacagattcaggccatcgcgcttgggcaaatgttccaggcaatcgaccaccagcgccagatcgaagcgctgcgccgccagttcggcaggcaaggcgccgggcgcggcgtgggcgacgacggtgtcaggatgcgcctctttaaaggcgctcagggccgaaaactcgctggcgccgatcagcaaaagacgcgccggtgcgtagcgatccagcaaagcggccaacgcctgttgcggcgtgcgggaagaaatggcgacgttcatcgaagctcctcaatcagaccgccaagactagcgcgctctatcattggagcctagcgccctgtctcgcgggtttgcggcaaaagcgtcaaagtcctgtgaacacgctcgcaaacagcggtggcctattgctggcggagattaaaactccggtctttactccctgaatcggttctaagccgatccctcaggagaaaaccagatgagcatagttcggacagcattacctttgattctgctaaccagtgtgttgactggttgtgcaggtttgcagaaaaccgactggccgacctgtgcggcggtcggtggtgtggtgggtgccggtctcggcgcgaccgagagttcggcgtgggccggctacggcgcgttgctgatcggtggcacggcagcggcttattgctgggtgcacggtgatggcgacgaagatggcgatggcgtgccggacagtcgcgacaagtgcccgggcacgcctaaaggcgtacaggtcgacgctgacggttgccctccaccaacgcctgcacctgtggtcgaagaagctgtagtggtcaaggaagaaaccattgtcatccgtgatgtgcacttccagttcgacaaagccacattgaccggccctgacaagcaagtactcgacaaggtcgccacgcgcctgaaacaggaatcctctacagcacaactgaccgtgaccggccataccgacagcgtgggcagcgatgcctacaacaagaaactgtcggatcgtcgcgcccactcggtggtggactacctgattcagcaaggtgtgccgcgcgccagcttcgtttcggtgtccggtctgggtgaaagccagcctgtggccgacaacaaatccgctgacggtcgtgcgcaaaaccgtcgtaccgaaatcaaaatcgtccgctagacctctcgcatccgcggcttgtgcagtcgcggatgcgggtctttactcctgtgtaaccggtatgggccggtgacacaggagctttcacaatgactgttttctcaaggtccgtcttgccggtactgctgttaggcagcttgctcaccggttgcgccactcacagcgatggcgatgcccccctcaatcaacgtacgtggccgatctgcagccttatcggcgggctggtcggtggcggtctcggcgccattgaaagtgctggctgggccggcggcggtgcggcgctggggatactcaccggcggactgatctgttacgcccaggacggcgatgaagacgacgacggcgtgttcgaccgccgcgaccgttgcccggatacgccggccaataccccggtcgatcaccgtggttgcccgttgccgcagtacccggtcacggaaaaagtgccggagcctgcaccgcagacggaagtcatcacactcagcgatgccggcaatgtgctgttcgatttcgacaagtccgacctgaccccggctgccaaagcccagctcgatacgctgatggacaaactgcgcaatgccgacgtggtgagcatcaaggtcatcggccacaccgacagtaaagggtcggatgcctacaaccaggcattgtcggaacggcgtgcgagcagtgtcgccgcttatctgctgagccagggcctggcgccgaacaaactcaccagtgagggtcgcggtgaaagcgagccggtcgccgataacgccaccgatgaaggccgcgcgcagaaccgccgggtggagttgcacatcaatcgttaggacgcgtctgtagggcgcaggctagagctgccggacgacgatcggcgtcgtttcggcagccatttggcaggcgacaggttttttttcaattgcccctctggcttatcccccgcagaagccgttactgtgcgcccaaagaataattcgcaacacgggggagcgtatgaaagtgttctgggggctggggcggttgttgaccctgctgttctgctgcgtggtgctggccaatcagctggtgccgttcgtacatccgttgaatctgttggtcaatctggccggcggtctgttgttgctgatccatgtactcgaagtgttgctgtgcaaccgcagcctcaaaggccgtccgcacccttggcgtgaccgtggccgcatcctgttgttcggcgtattccacctgcaaaccatcccggccccggccgctccggaggcttcttcccatgcgtaaactttgcttgctcgctgcattcatctgccctttggcctgcgcccaagtggtcagcgtcgaaaccaattcgctgatgcgcctgcccaacaccgccagtaccttgcaactggagaaactcgaagtcgctgattacggcacgctgctgattccggccaacgtgaccgagttgagtgtcggtgagttgcgtcttggccatgaagcacgcatcgcgatcgttccgggcgagaacgctttggacatgaaggtcgttcgcgcagagctgagcgatggcagccagattactgcgcgtggagcgccgggcacttatgaaaaagccgcccgagccggacgcaatctgaatctgcaattcaaggcgttgaacgcgccgcaactgttggtcgatgcccgtggcggcaccggcgcgccgggttttgtcgggctggacggcggcaacggtgaagacccgggctgcacctatggctcggccgggcacggttttgatggcagcaacggcagtgacggtcagccaggcgcaccgggtgcgctggtgcgccttgaagtgccgcgcgaatttccggccgagctgatcaaggtcaatgttgctggcggtgccggtggcccggcgggtgttggcggcaaggcaggcaagggcggcaagtccaagggttgtctggtgtaccgcgccgatggcggcaagaacggcaaggccggtgcggatggacagcctgggccggtgggggcggcgggtgctgtgactgtgcagcgcctgtaagatcactgattgttcccacgctccgcgtgggaacacagcccgtgacgctccgcgtcactggacgcagagcgtcccttgcggcattcccacgcagagcgtgggaacgatcacggtcttgccgcggcaatcgccaccagcaccaacccgacaataagattaagccccaccacccgccgaatccgccccagcaccgccgcacccgccggccagtccttcgcttccaccgctttccgcagctccggcagcatcaacccctgaatgcggataaacagcgccgtcatcaccacatacaagcccatcatcacctgcacatatttcggcgcggtctcaaacccgacctgctgcaaatgcaacatgcccacgccgctgatcggcagcaggatcaccgcaacccagacccagcggaaaaaaccttgaaacacttccacccacaaggtcagccgggcaggaccgtcgagggccttcacagccgccgggcgcaagaccatccaggcgaaaaacatgccgccgacccagaccagggcggacagcacatgcaggggatagacgaggctaaaaggtgtcattggggcactccgttctgcgcgggattaattagcggggtatgatagccgccatccgaaaccactgaaaatttatccagcgttttttgcgcccgaaaattcatgatcagcactgaactcaaaaccacgatccagggcgcctactcgcgttttctagaggccaagagcctcaagccgcgttacggccagcgcctgatgatcgctgaaatcgccaaagtcctcggggatatcgacaccgacgacgaaggccggcgcagtggcgaccccgcgattgttgcggtggaagccggcaccggtaccggcaagacagtggcctacagcctggccgcgattccgaccgccaagctcgccggcaaacgcttggtcatcgccaccgcgaccgtggcgctgcaagaacagatcgtctacaaggatttgcccgacctgatgcgcaacagcgggctgaacttcagcttcgcgctggccaagggccgtggccgctacatgtgcctgtccaaactcgacatgctcctgcaggaaggccacgcgcaaactgccaccgcgcagctgttcgaagaagaaggcttcaagatcgaggtcgatgaggccagtcagaagctgttcaccagcatgatcgagaaactcgccggcaataagtgggacggcgatcgtgacagttggccaaatgcgctggaagacgccgattgggcgcgtctgaccaccgatcacagccagtgcaccaaccgtcattgcccgaacttcggccagtgcgccttctacaaggcccgcgaaggcatgggcaaggtcgacgtgatcgtcaccaaccacgacatggttctggctgatctggcgctgggcggcggtgcggtactgcccgatccgcgcgacaccatttacgtgttcgacgaaggccatcacttgccggacaaggcgatcggccacttcgctcactacacgcgcctgcgttccactgccgactggctggaaaccacggcgaaaaacctgaccaagctgctggcccagcatccgctgccgggcgatctcggcaagttgatcgaacaagtgccggaactggcgcgggagatcaaggcccagcaacagttcatgttcagcgcctgcgagcaggttgccgacttcaagcccggcgaagatgtcgagggccgtgagcggccgcgttatcgttttgtcgccggggtgattcccgagcacatccgcgaaatgggcatcgagctgaaaaagggcttttcgcgcctcaatgatctgttcacgcgcctgaccgacctgctcaaggaaggcatggacggcgaggtcaacatcggcatcgccagcaatcaggccgaagagtggtatccgctgttcggcagcctgttgtctcgcgcctccggcaactgggaattgtggacggcgttcaccgccgaagatccggaagacagccccccaatggcgcgctggctgaccctggccgaaagcggttcgctgttcgacatcgaggtcaacgccagcccgattctggcggcggaaaccttgcgccgtagcctgtggaatgtcgcttacggttgtctcgttacatcggcaacattgactgctttgggcactttcgaccgcttccgcatgcgcgccggtctgccgaaaaaagccgtcaccgcggtggtgccgagcccgttccatcacgccgacgccggtgtgctgcgcgtgcccgatctgaaggccgatccacgcgatgccgccgcgcataccgccgcgatcattcgtgagctgccggacctggtcgaaggttcgcgcggcaccctggtgcttttctcttcgcgcaaacagatgcaggacgtgttcgacggcctcgatcgcgactggcgcaagcaagtgttcattcaaggcaacctgtcgaaacaggaaaccctgaacaagcacaaggcgcgggtcgatggcggtgattccagcgtgctgttcggtctcgccagtttcgccgagggtgtcgacttgccgggtgcctactgcgagcacgtggtaatcgccaagatcccgttttcggtgccggatgatccggtcgaagcggcgctgtcggagtggatcgaggcccgtggcggcaatccgttcatggaaatctccgtgcccgatgcctcgctgaagctggttcaggcttgcgggcgtctgctgcgcaccgaagaagaccgcggcaccatcactttgctggatcggcgcctggtcacccagcgctatggcaaggcgatcctcaatgcgttgccgcctttccgtcgtgaaatatcctgagacaacggtgggcagttttgcccgccgtgttgtctatctctctgccatcacttttccattggccaatgttggtcgttagggagaactccgttcttatgatccgccgttcgttgcctgccgtattcgccttgatcttcgccacgccgctactcgcggcgcctgcggggcagcagaccctgttcaactttgtccgtcctgccgacgtggtgaaaatcgccaccgaaaacgccgacctgccgcaagccaacgccgagcaaacccccgagggcgaagtgctgcgccgagtgaccttcaacccggtggcccgcccgaccttgcgtttgacgccgcaaaccggtgcgtgggactggtcgcagtcggggatgatgaccctgcgcctgcagagtgcgatgaactgggcggttaccgtttacgtgcagatccagagcaatgacggccgcacactggtcagccgcgtcgatctgccggccggtcctgcgcagacgttgctggtgccactggtggctactgcgccgttgagccaaggcatgaaggccggcccgccgatgccgatgactgtcgatggtcagcgcattttgctggccagcagcagcggtgagattgatcgcagccaagtggtgtcggtgagtttgtcgatggatcagccgaaagtcgcgcagagtttgctgcttgagcgtttcggcgtgcaggacggcgagtcggtcagccaagcggtgtatggcaatctggtcgacgcttacgggcaatcgactcgcagcaagtggccagaaaaaatcgctaacgatgaacagcttaaatccgctgccgccaaggaacagcaacagctgaaaacctggctggccgagcgcgaaaagtcatcgctggacaagttcggtggctggagcaaaggcccggcgttcaaggccagcggtttcttccgcaccgaaaaacgtgacggccgctggtacctggtcacgcctgaggggcatccgttctactccctcggcgtcaacactgtcagcccggacgtcagccagacttatgtggcgggtcgcgaattcatgttcgaatccttgccgaaaccggatgagccgctggccagtcactttggtgaaggcgacaaccgtggcggcaatggcgcagatcaaggtcgaggctacggcaacgggcgttggtatgacttctacggcgccaacctgcagcgcgtgtacggcgagccgtgcaaaggggacagcgaaagtaaatccggggtcgctgaagcggcgaagactgaagcggcagaaaccgctgccgccaaggcatcagaacctgtcgctgtgccggctgagccgaagtcaggcgtcgccgaagcggccaagactgaaaccgtgcaagtggccagcgaaccggctgccgcaccgtgcaaagcaactattgatgagtcgcagtgggccaaccacacgcttgatcgcctgcaagcctggggtttcaacacggtcggcaactggagcgccgattcgctcagtgaagccgaacgcgtgccgtacaccttgccgctgtcgattgtcggcgactacaccagcatcagcaccggcagcgactggtggggcggcatgccggatccgttcgatccgcgtttcgccatggccaccgagcgtgccgtggccatcgccgcccgcgaccatcgcgatgatccttggctgatcggttattacgctgacaacgaattggcctgggccgggccgggcgacgatccgaaatcgcgttacgccttggcttacggcacgttgaagatgaccaccgacgtgccggccaagcgcgcgttcctcaagcagttgcgcgacaagtaccgcaatcaggccgggttgtcgaaggcatggggcattgatctgccggcgtgggagctgatggaagacccgggttttgtgccgccattgccgaatcccgaacacccggaaatcgaagcggacttcaaatatttccagaaggtcttcgccgacacctacttcaagaccatctccgattcgctgaaatggcacgcgccgaatcagatgctgttgggcgggcgctttgcgatcagcaccccggaagccgtggcgtcctgcgcgcagtattgcgatgtgctgagtttcaatatgtacacgctcacgccgcaggatggttatgactttgccgcgctgggggctttggacaaaccggtgttgattaccgagttcaacttcggctccgctgatcgcggtccgttctggggcggcgtgacgcaactgagcaaggaagaggatcgtggcccggcgtatgccaatttcctcaagcaggccttgagcgagccttcgattgtcggcgtgcactggttccagtatctggatcaaccggtgaccgggcgtttgctggatggcgagaacggtcatttcggtctggtcggggtgacagatctgccgtatcagggtttcgtcgaatcggtgcgcaagagcaatttgcaggcgattgatcagcttggcaaagaggctgagaaagcggccgccgcagcggggcatgaggctgagggcggccgcaaaggcgaagccggtaatggtccgggggcagggcatgccggcggtcattccggcaatggtcactaacctgtgatgctctaacaagatcgcagcctgcggcagctcctacatggaaacgcaatccatgtaggagctgccgcaggctgcgatcttttgacttggcttttaaccgtctggcccgcagctgttcccaaatccctcaagggctggaacaatgcgggccactttgtagagcgttttcgcgggggagttgcgggtgcagattcagggacattacgagcttcaattcgaagcggtgcgcgaagccttcgccgcactgttcgacgatccccaggaacgcggcgcagccctgtgcatcaaggtcggcggagagactgtcctcgacctctggtccggtactgccgacaaggacggcgccgaggcctggcacagcgacaccattgccaatctgttctcctgcaccaaaacgtttactgcggtcaccgcgctgcaactggtcggcgaaggcaagctgcaactggatgttccggttgcgcgctactggccggaattcgccgccgccggcaaagaatccgtgaccctgcgccaattgctctgccaccaggccggtctgccagctctgcgtgaattgctggcgccggaagcgctgtatgactggcaaaccatggtcgacgctcttgcggccgaagcgccatggtggacgccaggtactggccacggttacgccgcaatcacttacggctggctgatcggcgagctgctgcgccgcgccgacggtcgtgggccgggtgaatccatcgtcgctcgtgtcgctaaacctctgggtctggattttcatgtcggtctggctgacgaagagttccaccgcgtggcgcacattgcccgcggcaagggcaacgctggcgatgccgccgcgcaacgcctgctgcaggtgaccatgcgcgagcccgccgcgatgaccacccgcgcttttaccaacccaccttcagtgctcaccagcaccaacaaaccggaatggcggcgcatgcagcaaccggcggccaatggccacggcaatgcgcgcagtctggccggtttctacgcgggcctgctcgacggcagtctgctcgaaagcgacatgcttgaagagctgacccgcgaacacagcctcggcgaagacaagacactgttgacccagacccgtttcggtctgggctgcatgctcgatcaaccggacgtgcccaacgctacctacggcctcggtcctcgtgcgttcggccatccgggtgcgggcggttccatcggttttgctgaccctgagcatgatgtcgcgtttggttttgtgacaaatacccttgggccatacgtcttgatggatccgcgtgcgcagaagctcgcgcgggtacttgccacttgtctgtaaagtttcatccgaggtcccagggtcggaacctcaagcggtttttcgtttcaaaacggctgtttatccgggcgaaagtgctctgatttttcattacttcattttgtggattttcaatgtcatcgaaaaagaccctcgccctggccctgtgtgtagcgatcaccggttgcgcacagaccccgaaaaacgatgcggacggcagcagttggtggccgttcggttcttccgacaaagtggcggccaaggagccggctccggcgcctttgaagccggcggcgactgcaccggttgccaaaactgaaagcagcaacccttggtactggccgttcggttccgatgacgaagccgccaaggctgacatgaaggcagaagtagcgcctgaagccaggaaaccggttgccgtggccaaggctgacgccgataccggcagcaaatggtggtggccgttcggcggcaaggatcagccgaccactaaagcggtgccgatgcccgatccgaaagtcactcaagcctggctggatgactacgagccgcgcctgcgtgaagcggtcaaggacagcaacctgcaactcgaacgccgtgaaaacgtgctggtcgtgactgcccccgtcgaaggctcgttcaacccggatcgtccagccatgctgctgccggtcacccttggcccgttcactcgtgtagcgaaaatccttgaggccgacccgaaaactgccgtgctggttcttggccacagcgattccagtggtgccgcgcctgccaacatcaaactgagccaggaacgtgcccagtccattgcggcgatcttccgtctcagcggcttgcagcgtgatcgcctgatgctgcgcggcatgggttccgaagcgccgcgcgccgccaacgacagcgttgaaggtcgcgccctgaaccgtcgtgtcgaactgctggtgaccccacagaacaccatggtcgcgctgctgagcaagtacaacatgcccgcgccgaagccggtgaccctggtcgcggcgcaagacgtcaagccagctgccaaaccggtaaccccggctcctgcggcgaaaaaagctgctgttccggcaaccaaaaaggctccggccaagaaaaccgctgccaaggctccagcgaaaaaagctccagccaaggccccagcgaagaaaactgcaccagccaaagccgccgcgaccgacaagaaagtcgccgcgaccgataccaccaagaagtgatccgctaacgaaaaggaatgcgccatgacccaggctctggcagatatgcgtcgtgattacacccgggatggtctgaccgaggcgcaagccccggccgagccgtttgcgttgttccaccagtggttcgccgacgcggtgaaaaccgaacaggcaccggtggaagccaacgccatgaccctggccacggtcgacaaggctgggcgaccgcattgccgcattctgctgctcaaggggctggacgagcagggcttcaccttcttcaccaactacgacagcgccaagggccagcatctggcggccaacccgttcgctgccatgaccttcttctggccgaccctcgagcgccaagtgcgcatcgaagggcgggtggtgaaggtcacccctgcggagtccgatgcgtattatcaggtgcgtccgctgggcagccgtctcggtgcctgggcatcaccgcagagccgggtgatcaacgggcgcggtgaactggaagatctgctcaaagccaccgaacagcgtttctccgatagccaacccgactgccccgaacattggggcggttaccgcttgctgcctgagcgcatcgagttctggcagggccgtccgagccgtctgcacgatcgcctcaactaccgtgtgcagggcgccgactggattcttgaacgtctggcaccctaagcagtctaccgagcgggatagcctgccgcagcggcctccagccacttcggcagatcccggcgcttgatcttctgcgcctgagcgttcgccaactgttcgagcatgaaggcacgtttgccctcgtccttgccggccaatgacagcgccaggtcgcgatccatccagcgtttgatccgcacgtacaaccaccaatggaagtacaaaccggcggccgtggtgacgacgatgatgaagtaatccatgaaaatcctggggtcgggtggcgcagaatcggcaatttggcgctactgtagggctatgtcagggaatgcgtgcggcgtctgtaccgcgcctgaatgaaagcgaatttgtccgggctgcgtcgtgacaggcgtcaagccacggagtttaatgaatatatgttcctttggagttgatgctatgcgtaagtctgttctgctggttgcttccttttccacgatggcgatgttgctcaccggctgccaatcgagcctgaccggtgactcctactcccgtgacgaagcgcgtcgcgtgcagacgattcgcatgggcaccatcgaatccctgcgcccggtgaaaatcgaaggcaccaagaccccaatcggcggcctcgccggtgcggcagtcggcggtgttggcggcagcgctatcggcggcggcaagggcagcatcgttgctgcggtcatcggtgcggtggccggtggcctgatcggctcggcgactgaagaaggtctgacccgtacccagggtgtggaaatcaccgtgcgtgaagacgacggcagcatgcgtgcctacgtgcagcaggttcaggagaatgaagtgttccgcgttggcgagcgcgtgcgcatctccaccgttggcgggaccagccgcgtttcgcactaagcggaattcagggtaaagaaaaccccgatcaggtgactggtcggggttttttgttggtcgcttaccaatggtcgcggtagacgaaagcgacctgaaagtcgaaagaggataaatcaatggtttgtctaaaatggggttgcaggatattgacccattgcgagggcacatcgaatcctccgttgttcacattattttcgattggcattccaagtgattcgataattgaaccgtcgtcaccgaagtctttcgataactcttctccttcgcccagttcagttttcttgtcataccattcaagcctggctcttaatcccatagacccctcatagaaatttcttaatgctgcgtttcttcttttttggcggatctaactgcttaccggttttgtggtcgaacgatcccaagtgagtgccatcacttgcccggtacgtctcaagttctccatgtagaaaatcccatttatatattgttctgcctttcgcatccgtccagcgatctcggagaccacccgcgtatggggttttcttttttgctcttctcaaatcgggaaatgcagtgatatcgcgtgtttcgggagcaggatggtaggtatgtccagcttcggcggtaccgtggcgtcgaacatttagaacaatataaaccggccgaaccccggagttcgggggaaacaccagaataaaatcccggtactccggtggataaaccgggttaaccagaatcccatccgccgctttcgtcggcggataaacccagatgtgcggtgcctgcggtgcagcctccagcgcgggaataccaaggatgtccgagccatctacagcaggcgtccagatcagttctacgccttcgcccaagtcagcaatgaactggctgccacgcaacttgaactgcacgacatcaaccatttcccaatcgcgattcttgccggtgtagaagccgtagcccttcaggctgccgtcggcctgctgttcgaccctcaaccgaacacgcgttcgcgcctgttcaagtccacgcagttgttcgtcggtatagagcgcgctgtcaccaaggctcgatggcatgaacagcgcaaccaaaccaactaaaggcgcaacagccgcactagataaagcagcgggcagtgcttcaaacaccgatcccgccaacgccagactgccaaacccaactggaatagctgtcgcaccgattttctttagaggaactgcgccgttttcatcggcctcacgcgcgcctagcaggatcaggtcgccgtaatccttcaggctgtcagtcggcaccatccccgaaggactggagtaatcgataatcgcatccggcaatttgcaggacttggcgaatacgcagccggcacgaacggcctctgtctttttgaccgccacctcacggctgcgctcgaaagcctcctgccgcgccagcatgccgtcgtaagcgttttgtctggcgtcgcgctcggccagttcagtggccgtcatatagcggtaggtgacgtgatgcccgtcgccttgcggtgggttttgaacccgaggaatctccttgttgcgagccactgatcgtcctttcgctcatccatcgacagcccttcgcaaagggctgcgcaacgttaacgaaggaggaaaatggtggctgtaggacgcgtctctaaagacgtggggattgttcgacggattctgatctgtagataggctgttgttcgagactcagaggattgaaccctcaggaaaaattcgttcagcgcactacagtaatttgtcgagcacgaactctttgaaccacggtggctgagtatctgatttgatttcaatcaactcgccatcagtgatttccgcaatctgcgtgaggccctcgctaccttcatccgagttatcgaaaatataagctctgttggaggtcaggatggcatcagatagaagctccaaagatctccaataccgcgcttctattttttcagggggaacgctgtgcccgccttgtgagactcgataggcgaccctggcaatgttgatctgaggatcggcggtagcgacgtagtaaacatacactctgtaaccggaggcgtgagcttcagcgagcagtttgaccttgtcagaggacgacatgacggtttcaaacgtaaagctgatgcgctctttgatcaaagatcttcgtatgaagtcggaaagggctgatgcgacgtaggagtcgatttcagtatttgcgaagctgagccgttcaccgtcaattgtcagagaatccagctttgccaatgagtgaggggctttcttgagcaaagcgtgctcacggaaaaactcaaaaatgtcttcttgtggtcttcgatacgataagaggtgaagtcaaaaaaaccggtatctttgattgagcgctctatgtcatcaggatttatgtagttgcccagcaaatgcgcgggaaccagtcgattgaaagtgctttttcctgacccgttgggcccagcgaatatccgtattctcggtgtgctcaagaagtgacctgtttcgaggatttgttgatgtgcaggcgagtgccgcttttcaggtttccgtaggtaccgattgtgcgcaaagcgacagaactcttctctgtcacttcaaacagctgaccatctttagcaacgagcaccgcggcgccattggcgagcgccatcttgtacgcgttgctgaatgccttcagagcgatatccggaattcgcgattcctgtacggaaatctgatcgtccgtcattgggcgtttttctgctttacgtgacatggatgactccagaaacgatgttgcgtaggtgtggctgtcaatgaaagatatagcacacttgcaaggttcagagccaagcccctctatatagaagggctatgatttcttaaggaagcgtttcagacgttttgcagagtattccggcgactcgccgccgccgtcaccgcataaccaatcaacgccgccagaatcgacccggtcaaaatgcccatccggtccatgcctgcgtagtcactcacacccggctcaaacgccagcgagccgacaaacaggctcatggtgaagccaatgccgcagaggatcgccacgcccagcacctgaccccagttggcgccttgcggcagggcggcgatgccggttttgaccgcgagccaggtcagaccgaacacaccgacggtcttgcccagcagcaggccgaccgcaatacccatcggcacgtgatgggtgaagctttccatggtgacgccgctcagcgacaggccagcgttggcgaaggcgaatagcggcaggatgccgtaggccacccacggatgcagcgcatgttccagggtcagcagtggcgacggctcggcgtttttcgtgcgcagtggaatgcagaaggccagggtcacgccggccagcgtcgcgtgcactccgcttttgagtacacaaacccagaggatcagaccgatgatcatgtagggcccgagtttgaccaccccgagccggttcatcgccaccagcgacgcaatgcaggccgccgccagacccagcgacagggtcgagagttcgccggagtagaagatcgcgatgatcacgatggcaccgaggtcatcgatgatcgccagggtcatcaggaacagtttcagcgataccggcacacgcttgccgagcaaggccaatacgccgagggcgaaggcgatgtcggtcgcggtcggaatcgcccagccatcaagggctgccgggttgtcacggttgaggaaccagtagatcagcgccggtaccagcatgccgccgatcgctgccgcgccgggcaggacgatttgcgagggctttgacagttggccgtcgaggacttcgcgcttcacttccaggccgataagcaggaagaacatcgccatcagaccgtcgttgatccacagcagcaggggtttagcgattttcaacgcaccgatctgcgccaccacgggggtgtcgagcaggccggtgtacagccacgacagcggcgagttgttgataatcagggccaggacggctgcggcgatcaataacagaccgctggcagcttccaactgaaagaaacgcgtgaaagtgctacgcagaggcaaggtcgctctccatcgaatcgtcaaaaaggtgggacaccctaacccgtactgttagttgttaaaacaaaagttatattcttttttgttatatgtcgttacaaggtgtctggcccaagccacgctgagcctagcagttgcctgacatattgagactcagctgtatctgtgcgcgctatcggaattttcctaagctgatgagtgagcctttcgaacaggttcatctcctgccgattcaacgagaaccatcaccatgagcgacaaccgacagtgggcccgcgaagccatccgcatcatcgaagcggattttcagcgcagcgccgacacccacctgatccctttgccgctaccaggttttgcgggcatcgagttgtacttcaaggatgagtccagccatccgaccggcagtcttaaacatcgcttggcccgttcgctgtttctctacgcgctgtgtaacggctggctgaaacctggtgcgccggtgatcgaggcgtccagtggttcgacggcgatttccgaggcgtatttcgcgcggatgctcggtttgccattcattgccgtaatgccagcgaccacctccaaagagaagatcgcgcagatcgagttctatggcggcaaaagccatctggtaaaagatccgacgcagatctacgccgaatccgagcgtctggcccgtgagcacgatggccatttcattgatcagttcacctacgccgagcgcgccactgactggcgtgcgaacaacaacatcgccgaatcgattttccagcagatgcgctacgaaaagcacccggaaccaagctggctgatttccagtccgggcaccggcggcaccaccgctaccctcggtcgttacgtgcgctatcgccagcattgcactcgcgtgttgtgcgccgatgccgagcgttcggtgttcttcgattactaccagactggcaatgccagtttgcgtctggattgcggttcgcgcattgaaggcattggccggcctcgcgttgaggcgtcgtttctgcccaaggtgatcgatgcgatggtcaaggtgccggacgccttgtcgctggcggccatgcattatctggcgcagcgtctgggccggcatgtcggcggatcgagcgggaccaatctgatcggcgccttgatggcggcgcagcagatgcaagcggcgggggagtcggggtcgatcgtggcgattctgtgcgatggcggcgagcggtatgcagacacgtattacgatcaggattggctgcaggcgcaggggtatgagctggctgggttgatcgaagcggtggcggcgagtgccgagcgcggtgaggcgctgccgacttcagtcctgcgtgccaatatctgacacaccgaaatcaactgtaggagtgagcctgctcgcgatggcggaataacattcaacattgatgttgaatggactaccgctatcgcgagcaggctcactcctacagggttttgtgtcagtcagtcagtcagtcaggccgagaatatcgcgcgccacggcttcagcaatgcgaatcccgtccacacccgccgacagaatcccgcccgcataacccgcgccttcaccggccgggaacaagcctttgacgttcatgctctgcagcgtctcgttacgggtaatgcgcagcggcgaggaagtgcgggtctcgatcccggtcaacaccgcatcgtgcaacgagtaaccgcgaatctgcttctcgaacgccggcaacgcttcgcggattgcctcgatggcaaaatccggcaaggccaaggccagatcgcctagcgctacacccggtttgtacgacggctcgacttcgcccagttcggtcgaaggaatgtcgttgatgaagtcgccaaccagttgcgccggcgccttgtaatcgctgccgccgaggataaaggcgtgggattccagacgttcctgcaactcgatcccggccagcggcccgcccggataatcgacttccggggtgatgccaacgacgatgccggagttggcattgcgctcgttacgcgagtactggctcatgccgttggtgaccacgcgatttggctcggaagtcgccgcgaccacggtgccgcccgggcacatgcagaagctgtagaccgaacggccgtttttggcgtggtgcaccagtttgtagtcggcggcgcccagtttcgggtggccggcatatttgcccagacgcgcgcggtcgatcagcgattgcgggtgttcgatgcggaaacccaccgagaacggtttggcttccatgaacacgccacggctgtggagcatgcggaaagtgtcgcgggcgctgtggccgagggccagaaccacgtgtttcgaatgcagggtttcgccgctggccagttcgacgccgaccaattggccgtcttcgatcagcacgtcggtgacgcgttcctggaagcgcacttcaccgcccaattcgcggatctgttcgcgcatgttttcaaccatgccggtcagacggaacgtaccgatgtgcggcttgctgacgtagaggatttcttccggcgcgccggccttgacgaactcgtgcaggactttgcggccaaggaacttcggatccttgatctggctgtacagcttgccgtcggagaacgtgcccgcgccgccttcgccgaactgcacgttggactcggggttgagtacgcttttacgccacaggccccaggtgtccttggtgcgctgacggacttccgtgccacgctcgaggacgatcggcttgaagcccatttgcgccagcagcaggccggcgaagattccgcacgggccgaaaccgacgacgatcgggcgctggctcaggtcgctcggcgcctgaccgacgaatttgtagctgacatccggcgccacgttgacgttacggtcgtcggcgaacttgcccaacactttggcctcgtcgcgcacttggaggtcgatggtgtagatgaagcacagttcggaggactttttgcgcgcatcgtagctgcgcttgaacaaggtgaaatcgagcaagtcatcgctggcgatgcccaggcgctgcacgatggcagggcgcaggtcttcttcgggatggtcgattggcagcttgagttcagtgattcgtaacatggcgaggatccgggttcgcggggcgcacaactgcgccaaggcgtttgaaggccgcgattataagccgcaaaggccggatccggtgaggctaaaacgctcagtcgttgcgcgatccgccgaaatacccgcaaccgcgctgcacctggccgtcgatgcgcaactcggcgctcatgtgctgcacgctgccggtgctgctgtcgacgcagcgttgcggcgcgacccacaattcgatgcgctggttgttggcctcgctgctgaggttgaagcggccgtcgcccagttgttcttcaacataaggtacggcgagtggtggctggccttcgcggtcaatgaccatgcctttgccgctgaccttgacgttccattccgggccatggccggcagcgcgcaggatcagcagtttgaaattagggtcgtcgcaggctgtgccggagcgttcgacgcggtacaactgagtcagatcgagtcgatcgcccgagactttgccgcgaacatcggcaaacagtttgccttgctcgtcggccagggtggcggcttcttgcaggacgctggtgccgccgatgtcattgaccaccaattggcgctgatcctggcacggctgaaacaccagtttgccgtcagcggcggtcaattgcccttgcatccgcgtctgcccgacgtgcgaggcactttctcgctggccatcgaacaactggcaggcggcaaacaacggcagcagggcaacaacggctaacgaacgggcaacacgcatcttcggctctccagacaagtgccgccacgttacgcagcctgacagttgatcacaagggtttagcccacgtgaaacgtctgacctgtctgcaagccttcgacacttttcgcgtaggccaacgccacatccgccgcaggaaccggcttgtagcctcggaaatacggggcgtagctacccatcgcttcgagcagaacggtagggctgatcgagttcactcgcagaccgcgcggcagttcgatggcggcggcgcggacgaagctgtcgagagcgccgttgaccagcgctgccgaggcgccgctacggatcggatcgtggctgagtacgccgctggtgaaggtgaacgatgcaccgtcgttggcgaactcacggccgatcagcaatagattcacctggcccatcagtttgtctttgaggccgagggcgaagctgtcttcattcatctcacccagcggggcgaaggtcacgttgcccgccgcgcagaccagtgcatcgaacttgccggtctgttcgaacagcttgcggatcgatgcgctgttactgatatcgacattgaaatcgccgctgttgcgaccgatacgaatgacgtcgtggcgttgcgacagttctttgtccacggccgaaccaatggtgccacccgcgcctatcaatagaatcttcatcgagctgtacctcaagtgattgaacgaggtttcagtctagagtggttttttctgccgataagcgcactaataggcaacctttggttttcaaatggaaacaatccatgagcgaaatggatgatctggcggcgtttgccgtgctgatcgaggctggcagtttcaccctggcggcgcagcaactgggctgcagcaagggtcagttgtccaagcgcatcagccagctcgaagcgcagttttccgtggtgttgctacagcgcaccactcggcgcctgagtctgaccgctgcgggcgcggcgctattgccgcaggcgcaagcgctggttgtccaggtggaaagagcgcgacaggcgttggcgcgcttgaaggacgatatggctggtccggtacgaatgacggtgccggtgtcgctcggggaaactttcttcgatggcttgttgctggagttttcgcagaagtatcccgaggtgcagatcgagctggagttgaataacagctaccgcgatctgtcacgcgatggttttgatctggcgattcgcagcgaggtggccaatgaccaacgactggtggccaaaccgttactggcgtggcaggaaatgacctgcgccagcccggcttatctcgaacgtttcggtgaaccgctgacgccacaggcgctggccgagcatcgctgcttgctcaacagccactacagcggacgagaagaatggctgtatcaccagcagcatgaattgttgcgggtgcgggtgtcagggccgtttgccagtaaccattacaacttgctgaagaaagccgcgctcagcggcgccggtatcgcgcgattgccttcctacctcctgcaggcggaattggctgacggccgattgcgctggctcctgcgtgactttcagacccgacgcatgccgatgtacctcgtgcatccgtatcagggcggtttgccgaaacgcacgcaggtgctcgcggactatttgatcggctggttcaaacgcagcggtgaagcgttggatcgacttcagcgttgacttcattctcctgtgggagcgagcctgctcgcgaaagcggtttcacagacacttcatgtgttgactgaaccaacgcattcgcgagcaggctcgctcccacaaggattctgtttattttgcgaaacggcgggcgatcagatgatcaatcgacaacttgcccggccctgtcgccatcaggtacagcaacaccgctgcccacgtgccgtgagtcggatacgcatccggatacacaaacagttgaatggtcattgtcatccccaacagcgccagtgccgaaaaccgcgtggcgaagccgatcaggatcagcagcggaaaaaagtgctcggcaaaagcggccatgtgcgcggcaaactctggcgacagcagcggcacgtggtactcgcttttgaacagcgcaatggtcgagtcggccaagcgcggccagccaagttgaaaggtgccgtcgatcaagtcgatggccagcccttcgaccttggtctgcccggacttccagaacaccgctgcaatcgagaaacgtgcaatgacggcaatcaggctgcgggggattttctccagcagcgcgatggcgcgggtgatgaggttgttcatggcagttccttgttgttcaggtgaatgatgacgttgcgagcgatcagcaagccgagggtttggccgagatcgaattccgggctgttttccgttgctgccaacaagggctggccagcaaccagatgacgaataaacacgctggcgccgggttccagggcaaatacctcgacctccagaccgttgcgcagcaccagagcgtgttgcccgtggttgacgtcgatgtgctccagcgttgcttcccgctgatgagcggcccagatcgcaaccacggcgtaggctgagtcgagcagatgcagagaggggtgaagttgcaggcgcaggtcaatcaaggcctgagcggcggtcagtgcggcggtgatgtgctccggtcgcaccgcagttgcgtcagcggcgtgataggcgcaagtgcgcaggtgttcaagacgtgccacgtccgccagatatggcacgctggtggccggttcaaacgcggcaatgaagtccgcgaacgcttcgccataacggttcatcaacggattgtgtggtggttgttcctgtacgaaaactgcggccatggcgcggaaaaactcctcgcctgtcaattgcacaaccaccgggtaactgtccgccagcgcattgatcagtgaggccagcacgttgttgcgatacaccgaaaaacggctcgcgggatctgcaccgttggggctgcagaggccatcggggcagggcagtcgcacatcgagcagtgcagcgctgaacgctgcttgagtactcatgactgacccccggcgcccatcagcaacgtgtcggcgtgctgtgcttcggccagcagcaccgcgaacgccggcacctgattgtcgcgttcgatcagcgtcgcaatcgagccgatgcgcttcagtgtctgtcgatacagattccagacggcccgatcaatcggcgcaccgtggtcgtcaatgagcagacgatcaccgaggctgtccgaatcttcggcaaacccggccagatgaatttcgccgaccgtgtgcagcggtaacgcatcgaggtaagtcagcggatcacgctgatgattcacgcaggaaacgtagacattgttgacgtccaacagcaggccacagccgctgcggcggatgacctcggcgatgaaatctgcctcatcgagggttgagtgctgaaacgccagataggtggccggattctccagcagcattggccgtttgagcgtgttctgcacttgatcgatatgctcgcagacacggttcagcgtcggcgtgtcataggccagcggcagcagatcattgaggaacaccgggccatggctcgaccaggccaggtgttcggaaaaggagtgtggttgatagcgttccatcaactcggcaaggcgcttgagatgcagtgtatccaacgggccttcagcaccgatggacaagccgacaccgtgtagcgacagcggatatcgctcgcggatcaaaccgagaaaatgatgaaacggaccgccgtcgaccatgtagttttcggcgtggacttcgaagaaaccgatgtccggtcgggaatcgagcacttcacgaaagtgcccggtcttgagccccagcccggcacggggcgggagctcgcgcagggctgcctgagtggcggcaagggcaggatggttggctttgaacatgaccgtcactcaggcagatcgcggatcaggacttggctttgaaggcttccagctgaccgaaaccagtcggcgaggttttgctttcagtggtggcgcaggtgcctttcggaacgagtttccaggcgttggcctggtagtccattttcgccgtgccggcacaggtagtgcctgcacctgcggcgcaatcgttgtgacctttcatggccacgccaaagcatttttccatgtcggcgtctgcggcatgggcggtcgatacagcggccatgctcagagcagaaccgagggccagagccagggcggtggcggacagggtgcgggtggtagcagtcatgatgtttctccagtcttggtcagggtttttacaagcgcgtttgcgcttgcttgtccctctagagaaacgaggtggcgttgcgttacagcccgctcaaaatctttttggaaaaacgcaaaaccctgtaggggtgagcctgctcgcgatggcgtcatgtcagatactggtgatgttgaatgacacaacgccatcgcgagcaggctcactcctacaagggctttttggagaatctgaaaatcgtgcaggcacaaaaaaaacggcccgaaggccgttttgttgttcagcgacacacatcaaccgccgaggtacgcctcgcgcactttcgggtcggtcagcagtgcttcaccggtgccttgcatgaccacacgaccgttctccagaacgtaggcgcggtcagcgattttcagcgcctggttggcgttctgctcgaccaggaacaccgtcacaccgtccttgcgcagcatttcgatgatgtcgaaaatctgctggatgatgatcggtgccaggcccagcgacggctcgtcgagcagtagcagtttcggcttgctcatcaacgcacggccgatggcgagcatttgctgttcgccgccggacatggtgccgccacgctggttgaagcgttctttcaggcgtgggaacaggccgagaaccttgtccatttgctcctgatagtcgcccttgtcggtgaaaaagccgcccatggacagattttcttcaacggtcagacgggcaaacacccgacgaccttccggcaccaccgcgatgctcttgcgcatgatctgtgacgagtcctggccgaccagttcctcacccatgtagcggatgctgccgctgtgcgcctgcggcgaaccgcaaagcgtcatcagcagcgtggacttgccggcaccgttggcgccgatcagggtcacgatctcgccctggcggacttcgacgttgacgctgtgcagggcctggatcttgccgtagaaggtggaaacgttttcgaactgcagcatttacgcttcccccaggtaggctttgatcacttcaggattatcgcggatctgttccggcgtgccgtcggccagaggcgtgccctggttgatcacgacgatgtggtcggaaatgctcatgaccagtttcatgtcgtgctcaatcaacagcacggtgacgttgtgctcttcacgcagcacgccgatcagcgccttgaggtcttcggtttccttcgggttcaggccggcggccggttcgtcgagcatgaggatccgtggacgggtcatcatgcagcgagcgatttccagacgccgttgctgaccgtaagccaaggtgccggcggtacggttggcgaactctttgaggttgaccttttccagccagtactcggcaaactccatggcctcgcgctcgcttttgcggaacgccggagtcttgaacagaccggacaggaagttggtgttgaggtgacggtgctgggcgatcaacaggttctcgaccgccgtcatgtccttgaacaaacgcacgttctggaaggtgcgcaccacgcctttgagcgcgatcttgtgccccggcaggccttgaatcggctcgccgtccaacaggatgctaccgccggttggctggtagaaaccggtcaggcagttgaacacggtggtcttgccggcgccgttcggcccgatcagtgcaaccacttgtttctctttgacggtcagggccacgccgttgaccgccagcaagccgccgaagcgcatgctcaggttctcaactttcaagatctcgcggctcattttcgcaactccatgtgtgggcgttgcatcggcagcagaccttgtggacgccagatcatcatcaataccatcagggcaccgaacatcagcatgcggtactcgctgaactcacgcatcatttccggcaacaggatcatcaccacggccgcgagaatcacgcccagctgcgagcccatgccacccaatacgacgatggcgaggatgatcgccgactcgatgaaggtgaacgattccggcgtcaccagcccctgacgcgcagcgaagaagctaccggcgaaaccggcaaacgcagcaccgagggtgaacgcggacagcttgatgatcgttggattcagacccagtgcgcggcaagcgatttcgtcctcacgcagcgcttcccacgcacggccgatcggcatgcgcagcaggcggttgatgacgaacagcgccgccagcgccagcaacagggcaaccaggtaaaggaagatcaccttgttgatcgagttgtattgcaggccgaaatactcgtggaaggtttgcatgccttccgccgctttacgttcgaaggtcaggccgaagaacgtcggtttctcgatgttgctgatgccgttcggaccaccggtaatgtcggtcaggttacgcaggaacagacggatgatctcgccgaagccgagggtcacgatcgccagatagtcaccgcgcagacgcaacaccgggaagcccagcaggaagccgaacgtcgccgccatcaggccggcaatcggcaggcagatccagaagctcaggccgtagtagtgcgacagcagcgcgtagctgtaggcgccgacggcgtagaagccgacgtaaccgaggtcgagcagaccggccagaccgacgacgatgttcaggcccaggccgagcatcacgtagatcaggatcagcgtcgcgatgtccaccgcgccacgggaaccgaagaacggccacaccagcgccaccaggatcagcgcaatgatgaaatagcgctgggtggttggcagcgtgaggaagttgctcgctttggccgggatcagcggcagacccggcgatgaacgccaggccttgctgatctgctggttgaacagcacccgcaggaacatcagcaccgagcagatggcgatggtcgccagcacggtcggactggtgttgtgcacttccaggttgataccgacgatggtcagtttcaggccgagtaccgggtaggccacggcccacaccagcaaagcgctgaacagcgcctgtttaagattcctagtcatactttctcaacctccggacggcccagaatgccggtcggacggaacaacagcaccagaaccaacaagccgaaagccacgacgtccttgtactggtcgccgaagatatcggcgccaaacgcttccgccaccccaagcaccaacccgccgagcatggcgccagggatgctgccgataccgccgagtaccgctgcggtgaaggctttgaggccgacgaggaaaccggcgttcgggttgatcaccccgtattgcatgctcagcagtacagccgcaacggctgccagcgcggcaccaatgacgaaggtcagggcgatgatgttgttggtgttgatgccgagcaggttggccatcttgatgtcttcggcgcaggcgcggcaggcgcgacccaggcgagagcgggagatgaacagtgtcaggccgagcatggcgatcagcgtcaccacgaacaccacgatttgcatgtaggaaatcagcacttcttgtgcgccacctgggccgaaggcaaggttgcccggaatcaggttggggatagctttgtccttggagtcttgcgccagcagaaccgtgttctgcaggaagatcgacataccgatcgcggaaatcagcgggatcagacggttgctgccgcgcagggggcggtaggcaatgcgttcgatgctgtaaccgtaggaactggtgacgacgatgctggcgatgaacgccgcagtcatcaacagcgggacactgtcgagtcccatcatggtcaacccggcgatggcgatgaacgccacgtaggagccgatcatgtacacctcgccgtgggcgaagttgatcattccaatgatgccgtaaaccatcgtgtagccgatggcgatcaaggcatacatgctgccaacgttcaggccgttaaccagctgttggaagaagtgatagatgtcaggcattacagcgctcctaaaaacctgatacgcatttcactggtggagtcattttcccgcccggccccgtggatctttatccacttcgaatccgggttttgccagcgaaccgctgatgacggttttgagattttcaggtggggagactggcggatcacgccagcgcggcccattacattcgtaaaacaaagcccacggcacgccgtgggctttattggcagtcagtcaggcagcgccttactgaggcgatacttcagttttaggcttgccgttgtgccactcgtagaccacgaatttgaagtctttgaggtcgcccttggcgtcgaagctcaggtcgccagtcggggtcttgaaggtaccggcgtgaatggcttcagccactttggtcgcgtcttcggacttggctgccttgatgccttcggcaatcacttcaaccgccgagtaggacgggaacacgaacggaccgctcgggtcttctttcttcgctttgaaagcatcggccagggcgatgttggctggatcctggtcgaaggatttcggcagggtcaccagcaggccttcggacgcatccttggcgatctgggtgatcgagtcgttacccacgccttccggacccatgaacttggctttcaggcctttttcctgggcttgacgcaggatcagacccagctctgggtggtagccgccgtagtaaacgaagtcgacgttggcttgcttgagcttggcgatgatggcggagaagtctttgtcgccggcgttgacgccttcgaacacggcaaccttggtgcctttcttctcgagggtcgatttcaccgcggtggcgatgccttcaccgtattgctgcttgtcgtgcagcacgccgacaattttcggtttcacgtggtcggcaatgtagttaccggcggcagggccctgggcgctgtccagaccgatggtgcggaagaccattttgtaaccacgggcggtgatgtccgggctggtggcagccggggtgatcatgatcacgccttcgtcttcgtagatgtccgaagctggctgagtggagctggagcacaggtgaccgaccacgaacttgacgccgtcgttgacgaccttgttcgcaacggctaccgcttgtttcggatcgcaggcatcgtcgtattcaacggcttcgagtttcttgccgtcgacgccgcccttggcgttgatttgctcaatggccatttttgcgccactgaactgcatgtcgccgtactgggctactggaccggttttagggccggcgataccgattttgatggtgtcagctgcgaacgaatggctggcaaccccggccagaaccatagcggcaaacagtttggaaatctgcttagtagccttagtcatagtgctccactcttactgttgtaatttttttgagttctggcgccgtagcagcagaaccgggtcagatatctttgcgataccctccggaaatgcccccggcaactgtaccggtacagtgtagagcgccggttgtcagcctgggaagcgggcgccgaggggcaaaacttgggggtgtcgcgtttttgaatgaaaaagacagaattgcggcggggcgttcgtgggcatatatcccaatcagcagcattccttggcgttcctgctcttttcgttcggtacagccatttgcaaccgggttttgctggcggaccaccaacgttatcattcgcgtcgatttcttttccggacagcgcccatgaatcaagaacctagcaccctctatgccaagctgcttggtgaaaccgcatctattacctggaaggagttggagccgttcttcgccaagggtgccctattgtgggtcgaccctgcgctggatctgatcgctgccgccgaggccgtggcatcggatgatggcgagaaagtggctgcctggctggcccaagacaaagtcgccaagctgtctgaaacgcgggcgctggatcttttcgagcgtgatccggcgttgtgggcggtggtggtttcaccgtggattctgatccaggaaagggcggtcgcttctgacgctgcaccttgatggtgcggccggtcgtcagcgaaaagtgtgtagcggagtagcgtgatggcacgttgccgtagagaaacaccacaagcgcgggtggcctcacggtgacgtaaacgtaacgggaacagtttagtaagcagcctaacggctgcttaattgtttctggatatgatcgttcccacgcagagcgtgggaacgatcgtgggagcgagcctgctcgcgattgccgcgactcgatcctggatcagaccgagaacgacttgccggtatggttattgagggaaataaccttggtcttgccaatccggtgacggtaaatctcgcgcaaatacttgatcgatttcttcacacaatcgcgcgacaggcgaatgtcattgatcgagacaaacttctctttgtcgttgatcagctcacggtacttcttctcgtacatcggcttgatcgcgtaccagttggtatcgaggatcttcgccgggttctcgaactcgttgagcaggtcgtcgatgcggtcttcgtcgaactcctcgttgatgatgaaatcgaggattgagttgtccagggtctcgtcaaaacggtaaggattcttcgcgaagcaacgcttgatgaacgcgacgatcaaagtcaggaagtcatccgacaggcacgggcttttggcgatcaatgtagtcaacgacaggttggccgaggcgccgatcaccagcgcatagcgcttgagcgtggtgttggggaacaggctgttgaggtgggtcttcaaccggttcaggtccatgtacgacagtttgtagtctttcggcagcgagacgatcgagaccaccgacgagcagttcttgaagaagtgcaggtcgtgcagggcggcggcgtcgtagccggaattcttgtactgctcaagcgaggcgcgataacgcttggactcgatcggcaacaggctgatgccttcgatcgcctgcgtgaccttgttgaagtgcggcaggtcgatcgagcggaagaacagatcatcgatgttcagacgctgcggctctttatcgaacaccttgaacttgtcgctgctcggcggtggcgtttccggcaccaccgattcggcgtaggcaatcgccaccgggccggccagactcatgaacaggtcgttggcgtcgaggcgaatggtttcgccgatgtcgatgccggcgcggcggaagtagttctggtcgtagtcagtggtgactgcctgcgccgtcagaatgttgaagatctgctgcgagatgtactggttggcgtgcttttccatcgcattgacatcaatgttctggatgttgccgtcatcgctctcttcggcgtaacgcatgatgtcgttggagatcagcatcatcgcgttccatgggcggatacgccccatgacgctggcttcgctgctgtcttcgttggcgaagttgtaggagaaatcccattcttccgacagatatttgcacaacaggcgaccggcgttgatgtgcagcgcctcggacatttcgctgcgatgatcggaaatgttcggcagcacgcagataccgctggtgaagatcggctcgaacacgaacgagtggccgctcttgccgtcatgttcgtccatcggcttggtgtcgaacgtcttgttcatgtacgagtgctgctgggccagaccgaattccgaggccatgccggaaccggtaccgccgccggcactgaagatcgagaagtacaggcgcgactggttggccttgatgccacagctgtcgatcaggtacgagtggatcattttccagtctgggctggagaagcgctgggtgtccttgttgaggatgatcttcgccagatactggccgaggatcggcgcgttaccggcgccaccagcgtggacttcggacaagtccatgatcttcattttgctgtagtcgcgcaggaagccgcttttttcgcccttgcgcgagaagcgaatgcgcccggcgatgtccttgtcgaggtcgccgagcatcaccagcggttcgaccagaaacaccggtttggtcgatttgttcgggccgatgcgcaggttgttcttgatccactgggccgggctgtagcccttgtcggccagtcggcgatccgccgggcgatcttcgttgttgaattcgttgaggtagaacttgcgcgcgttgtacaccagctccgcaacatctagagcaatgttggagccgcagcgaccgaggccgatcaggcacaccgaggggaattcctggtcgttgtgctgttcgttgtcgccttccaggtgcggtgggcgcgggaacaccagatcacgcaggccgtcgaggttgtcgaggatgcggtcggtgttggtttcggtgaagtacaggtattgctgggtcgacagcgggcgcgacgggaccgatggcttcgacgatgacgggctgttcgcggcggggctcaacgtcagatcggataccgctggggcgggattgtttttagaagtcattgtgcgccatatacctggactgggtcggctcgcaggccaagtgcctgggaacctcacggaataagatctcgcgtcttttttgcgcgaattgagcccgagcatcagggttttggcctgactgtcgctggggggaatcctttcctgatcgttgatgaatcggccattattcggcgatctttaatcgaaaagaggcaaaatgatgtcaacgctaccttcgttggggttcgccggaatcggtctgatggggctgcccatgtgtcggcgtctgttggccgcgggttacccgctgaccgtgtggaatcgcaacccggccaagtgcgcgccactggtcgaggccggtgcccggcaggtggcgaccgccgctgaactgtgcgcacacgccgacgtggtgatgttgtgtctggccgatacggcggtcgtgcgcgaagtggtgtttggcgccgatggcattgctgccggggcaaagcgcggccagttggtggtggatttttccagccttgagccgactgctactcgggagatggcgaccgcgctggcgcagaaaacggggatgagctggctggactctccggtgtccggcggtgtagtcggtgccgaggcgggcagcctggcaatcatggtcggtggcgaggtggcagaccttgagcgcgtgcgcccggtgttgctcaacctcggtcagcgcgtcacgcacatgggcggcatcggcgccggccaagtgaccaaggcctgcaaccagatgatcgtcgcctgcaatgcgctagtgatcgccgaagtggtggcgctggccgagcaggccggtgtcgatgccagcctgatcgccgaagccttggctggcggtttcgccgattcgaaaccgttgcagattcttgcgccgcaaatggccgaaagccgtttcgaaccgatcaagtggcacgtgcgcacgctgctcaaggatctcgataccgccgtgaaattttcccgcgaacaaggctcggcgacgccgatcagcggattggccgcacaattgatgcgcctgcatggggcgcagggctttttggcgcaggatccagcgacactggtgcaaatgtaccgcgcgccagaatcaacggattgaccgcgtgtgagtgtttgcgctgattgatttcttccagtaccgggcgcagttcgtccagcggcaccggacggctgagcaggtaaccctgaatgaagtcgcagcccgagcgttcaaggaattcgtactgttccaggctttccacgccttcggtgacgacttgcaaatgcagggtgtgcgccatgacgatgatcgcctggacgatctccatgtcggcggtcgccgtgggaatgtcgaggatgaacgagcggtcgatcttcaaggtgttgagcggcaggcgcttgaggtaagccagcgacgaatagccggtgccgaagtcgtcgatcgacagcgatacgccgagcgcgcggatctgccgcagcaacaccagggtgttggcgatattgcccatcagcgcattctcggtgacttccagttccagccgttccggtgccactccggcagtgcgcaaagcgttttcgatctcgatggccagctcttcgcggccaagattcagcggtgagcagttccaggcgattttcagttcatcgcagccatggcgcgacaattcacccagatccttgcaggcccggcgcagcacccagttgtccagttcggcaatcaggccgttgttttcggcgatggtgataaaacgatccggggtcagcaagccgtgcagcggatgctgccagcggatcagtgcttccagtttggtgacacggccggttttcagttcgaagatcggttggtaatacagtgtcaggccgttttcttcgcgcagggcatggcgcagttcttcttccagttgcagctcgaagctggcgcgggtcttgaggttggaactgaaaaagtgcaggccattacgtcccgcgcctttggattgatacaacgccagatcggcgtgcttgagcagttcttcgcaggtgctgccatcttccggaaacagactgatgccgatactggtggtcatcaccatgcggcgtccggccaactcgatcggctccttcattttgagcatgatgcgttgggccatattgcgggcttcttcgcggtcatgcaggttgatgaggatgcagaactcgtcgccgccgaaacgcgcgaccacgtcttcatggctgcgcaccgagcctttgatgtgctgggcgatgactttgagcagttcgtcaccggcgtcatggccgaggctgtcgttgatccgcttgaagtggtcgatgtcgagaaacatcaccgcgagcatgccgccttcgctggttttctggctgagtttctcggcgaagatctggttgaacccgcgtcggttgatcaggttggtcagggcatcgtagttggccacttgttgcagcgacatgcgcgcttgatcgagctggctgagcagggcattgacccggcgcaggtcgtgctccttgttttgcaatttcttgtcggccagtgccgcgctgatcgcgctgccaaggatcagcaaggtaatcagcgcgaccgtgaggcctaattgcaggtggctggttccggtggcaatcgacggcagactgtttgctggcaagaccaggttcagcgccgccatcccggtgaaatgcatgctgatgatcccggcaccgagaatcagcgcggcggtgtacttgagcatctgatgagacaaaccgctgccttcgcgcaagtaaccggccaccgacaatgcggcgaaactggcgccgatggcaatcaccaccgacaggcagaacagcagcggttggtaataagcggttgcggccgattgcattgctgccatgccgacatagtgcatgccggcaatgccgaggccgatgacaatggcggttttcaggtattgggtcaggctcggttgcggctcgctcaacgtgtgcattgccagccaggaggcgaggagggcgatcagcagggagaacagggtaatggcgaggtcgtactggatttcgatcggcgcctggaatgccagcatgccgatgaaatgcatcgcccagatgccgccggccaggcaggttgcgccgatccagcgccagacgcgctgcgagccgggatcttccgcgtggcccacccgttcggccatgtcgagggtggcaaagcttgccgcgcaagcgaccagataggccaccagcaccagcaagggattatgagtgcaattgagaatgacctgcccgctctccggcagctcggtaacaaactgcaaaccaagccactccatagcatgccccgtctctgaagtcgtcctgactgcgtgatgaacgcaggcgaatgtctggagtatagaggcggttttcagagagcaagcggtagtggcacattggcgctaatgatttcgtcattagcctcatagcgattggcgctaaaggctcaagcgctctgttcgaaagggatttgcgcccagtccggttgcagcggcggcaagccgaagcgtgcacgagccttgtcgcaatcgacattctgttcgccgttttcccaagacgattcgaattcacgacacgggctggagcgttgttcgtaaatcgagcacttcacctcgctgccgacttcaccgaccaatgccgtgcaacgcggcgatttgcagtcggtaccgttcatcgccacccggctcgggctgatctgcgtgaccagttcatcaggcaccgtaccaccggaggaagcgcattcaccccagaaaaaagacacgcgaaaatgggaacagcaggcaccgcaattcagacacggactgacttcggacatgggcgagggtatcaaagggattgatcgaaagatccggacggatccggcggccattctaggctttgccgcagacttgggaaggggggcgcgaaactatttttttgtggcaaggttttgccgcaaaagccccggttttcgggggatcgctgacttatcaaaggcttacgtttcgttacagtgccatggcccgatatcaggcagacgaatgatcacagacagctcccgacgggctgactagattgcaggttccgggctcggatgcgttggcagtgaagccctataacaataaagagacggacccatgcagaactcgacccaagcggcgaatgcctggcgcattctgttcctgctgttcctcgccaacctgttcaatttcttcgaccgcaccattccggcgatcatcatcgagccaatccgcatggaatggcacctcagcgatttccagctggggatcgtcggcaccgcgtttaccatcgtttatgccatcgccggcctgccgctggggcgcatggccgacaccggttcgcgcagcaaactgatgggctggggtctggcgacgtggagtgcactgacggcggtcaacggcctggtcggcagtttctggagctttctgatcgtgcgcatgggcatcggcatcggcgaggccagttacgcgccggcggccaactcgctgatcggtgacctgtttccggcgcaccgtcgggcgcgggccatgggtattttcatgctcggtttgccgctgggcctgttgctggcgttcttcaccattggctggatggtgaaggcgttcgacagctggcgcgcgccgttcttcattgcggcggtgccggggctgattctggcgatcttcatgttcttcattaaagaaccgaagcgcggcgcagcggagaccgtgcaggtttcgcaggaaaaagtcgacaagccgatccggcggattctcgcggtgccgaccttcctgtggctggtgatggccgggttgtgcttcaacttcgccacctatgcctgcaactcgtttctggtgccgatgctgcagcgctatttcctcatgccgttgcaggaggcggcagtggccacgggcgtgattgttggcgtgaccgggctggtcggtttgaccctgggcggcttgatcgccgacaagattcaccagcgcgtggccaacgggcggctgttgtttgccgcgttcagtctgatcatttcgaccctgtgcacggcgtgggccctgcattccgggcgcattgagattggtgtgtttgtcgcggtgttcagtgttggttggctgtttgcctacaacttttatacctgtgtttatacggcgattcaggatgtggtcgaaccgcgtttgcgggcgacggcgatggcgttgttctttgccgggttgtatttgctgggtggtggtttggggccggtggtggtcggtggcttgtcggatcatttcgcgcacacggcgatgctggcggcgggggctgagcagatgaccgaggtgttcaaggcagtcgggctgcatgacgcgatgtacctgattccggtggcgctgtttttgaccatggtgtttctgtttctggcggcgcggtgttttgtccgggatgcgcagcggatgaaggaggggctggttgctgtggttgagccagaggttgcagtagcgactgcataaccgctatcgcgagcaggctcactcctacgggggaacgcattccaactgtaggagtgagcctgctcgcgatagggcccttagcatcggcaagtaaataacaggcaaacaacaaggcccgcatcactgcgggccttgttgttttcagcgctggagcggggcggtttagcccgccaccaacacccgaatcgcttccagacgcaacgccgctttatccagcatcgccagaccctgctcgcgctgttcacgcaacgccaccagttcgctgtcacgtacagtcgggttgaccgcttgcaacgcggtcaggcgcgccagttcttcgtcggtgtcggccgccagacggcgacgggcctcggccacgcgttcggcgtgacgcggggcaatcttgtcctcgccggcgttgatccgtggcgtcagctgatcgcgctgcgcctggatgaacttgttggcgctggcacgcggcacgctttccagttgatcgttcagtgtttcaaacgagacgcgtggcgacaggtcgttaccattggcatcaagcaggcagcgcagggcggccggcggcaggtaacggcccagttgcagcgagcgcggggcaaccacttcgctgacgtagagcaattcgagcagcacggtgcccggtttcaacgccttgttcttgatcagcgcgacggcggtattgcccatcgaaccggacagcaccaggtccatgccgccctgcaccatcgggtgttcccaggtgatgaactgcatgtcttcgcgcgacagcgcctggttgcggtcgtaggtaatggtcacgccttcgtcgtcgcccagcgggaaactggcgtcgagcatcttctcgctcggcttgaggatcagggcgttttccgaatggtcttcgctgtcgatgccgaacgcgtcgaacagagtttccatgtagatcggcagggcgaactgatcgtcttgctcaaggatgtcctcgaccagcgcttcaccttcgccggcgccgccggagttgagctccagcagacggtcgcgaccggtgtgcaactcggcttccagacgctcgcgctcgctgcgcgcttcgtcgatcagcgcttgccactcactgtcatcggcttcttcgagcagcggcagcaggcgtgggccgaactggtgctgcaaggcgttgccggtcgggcaggtattgaggaacgcgttcagcgcttcgtggtaccactggaacaggcgctcttgcgggctggtttccaggtacggcacgtgcagttcgatgatgtgcttctggccgatccggtcgagacgaccgatacgctgctcgagcaaatccgggtgcgacggcagatcgaacagcaccaagtggtgagcgaactggaagttgcgaccttcactgccgatttccgagcagatcagcacttgcgcgccgaactcttcgtcggcgaagtaagccgcggcgcggtcacgctcaaggatgttcatgccttcgtggaacaccgtggccgggatgccggaccgcacgcgcagggcgtcttccaggtccatcgcggtttcggcgtgggcgcagatcaccagcactttggtgcgcttgagcattttcagctgatcgatcagccattcgacgcgcgggtcgaatttccaccagcgctcttcttcgctggcgtccggctgggcctggaagctgacttccgggtacagctcggcgtgttcacccagcggcagttcgaggtattcgtccgggcacggcagcgggtacgggtgcagtttgcgctccgggaaaccctgcacggcggcgcgggtgttacggaacagcacacggccggtgccgtgacggtcaagcaattcgcgcacgaggcgggcgctggcttctgtgtcgccatcgttgaccgcagtcagcagcgcttcgccttcgttgccgaggaaaccctgaatggttttgtgtgccttggccgagagacggcccttgtcgagcagttcctgaacggcttcggccaccgggcgatagttgtcgctctcggcgcggaaggcggccaggtcgtggaaacggtttggatcgagcaggcgcagacgggcgaagtggctgtcctgaccgagttgttccggggtggcggtgagcagcagcacgcccgggatggtttcagccagttgctcgaccaaggtgtattccgggctggctttttcttcgtgccagaccaggtggtgcgcttcgtcgaccaccagcagatcccagccggcagcgaacagcgcgtcttgcgccttctcgtcgtcgaccagccattccaaggccaccagtgcaagctgggtgtcttcgaacgggttgctggcatcgctctcgataaagcgttcttcgtcgaacagcgcgacctgcaggttgaagcgacgacgcatctccaccagccactggtgctggaggttttccggaacgaggatcagcacgcggttggcgcggcccgagagcagttggcgatggatcaccagaccggcctcgatggttttccccagacctacttcgtccgccagcaatacgcgtggcgcgatacggtcggcgacttcacgggcgatgtgcaattggtgcgcgatcggttgcgcacgcacgccacccaggccccagagcgaagattgcaactggcggctggtgtgttcgagggtgttgtaacgcagcgagaaccacgccaacggatcgatctgcccggcgaacagacggtcgctggccagacggaactgaatgaagttcgacagctgggtttccggcagggtgacggcttcgttctgcccgttgagaccgtgatagaccatcagcccgtcgacatcgtcgacttgctgcacggtcatcttccagccttcgaagtgggtgatgctgtcacccggcgagaatcgcacgcgggtcaggggcgcattccgtagcgcgtactggcgggtttcgccagtggccgggtaaagcacggtcaacaagcggccgtcctgtgccagaacggtgcctaaaccaagctctgcttcgctgtcactgatccagcgttgccccggttgatactgctgcgccatgctgcctgactcccaccttgaaaaagcgggctatcttaacggaatcagggcttcagggccaaagattactgggtaggagctgccgaaggctgtgatcttttgatcttgggggaacacttggaatccgtgttgtcccattaaaagatcgcagcctgcggcagctcctgcagtgccaacccggtcacaagtttgcgaccgacggctcaaggcgcccttgccgcagccgatagcctgcagacaggagaccttttatatgttgccaccgatgctccccctgagcgctgtgccgatcacttcccagcaggatccgatccgccagcggccggacattcctccggtggtgccggtgcaggaaagctccaacgaaagtacgatcgatctgcaaaagcgcgatccggaagaggatcgactgctggcgcgtgaggaacagcgccgtcagcaagagcgtgatcgtcgccgtcgcgaagccgatgaagacccggaagaacatctggccgtgccgggtaccgagttgaatgccgacaacactgtgccggtggtgccgctgatggaagatcagccgcgtcagggcttgtgggtcgatatcgagatctgaggcgttttaccgcgtgtggctagccggctggtcagcgccggcctgaagctgcattattggcgcagtcctgccggtgattttggcagttgtgattctttcaagcgatgttccgaacgccatgagccaagacgacaaactgattgacctcagcactgaacgcgccaagcgcgtgcatgacattaaagagaagcgcctgaatgaggtgcgccaggctttcgagcaggcgatgccgttgggcaaagcaaagaaaaagtcgaagaacaagccgaaaaagcgttgatctcccctgcatccgttgatgcaggtcagttgttttccctcctttatctcccttccttgctggtattgatcccggtcaatttgtgcgtctgtgtgtttggtaacttaggtccatcgcagcagagcaggggccaggaggccagtcatgtttttcgataacgtggtgtttgccggggtcctgactgtagggctgatggttctgttttttgcagggtttggattttttatctggaaggatgcgaataagcgcaagaagtgattcttctggattgatgagcacgcaaggcattttggggcgacttcggttgcccctttttttttgtgtcttggcggcctttgggccgaccaggtttggggttgttttgtgtgaatatccgttgcttcgggtattgctgattttggttccgcccttacggcgggtcactttttccagacgccggaatgccggcccagcgaaaagtaaccaaaaaggcttgctcctacgtgcggcccgctcgctggggctcggggttccttcgctccgggattgatccgggcgcagcgcctacggtttgctgcgctgcacctcctctcgctgtgtttggctgcgccaaacggtcgctacgctcccacgcccggatcaatccctccactcagccttccgacgtcgcccgtggatcaagatcaagagcaggcgagctgacactcggcctattgagtggtgaagagcacgggtgttcggcttttgatttgcgttgttgctgcccctcaccccagccctctcccggagggagagggggccgatttctgggcttttcaagatctgagttcaacgcggtatcgcacgtcggcgtaccttccccaaacacctcaccctagccctctccctctgggagagggctagggtgaggggctcttgcttcaaagcttcaaagcttcaaagtctgagttcggctcggtatttcatgtcagcgtagctcgcccaaacacctcgatcagttccctctccctctgggagagggctagggtgaggggcttttgatttggcttgtgatcttgctttggctttggtttttgatcttttgccccatcggcaggccgagcgtaggtgttcatccgggggtaggcgcgcagcgccgtgcggcgtagccgcatacatcgagaggaggtgcagcgaagcaaaccgtaggcgatgcccccggatggacaccgtagcgaggcaacactgagcctcagcgaagtgccgtacgccggggcaagcctttttggttaccttttcgctgggccggcactccggcgtctggaaaaagtgacccgccgtaagggcggaaccctgatcagcaacacccgcagcaacggatatgcccccaaccccaatcccaaaaccccaaacacaaaaaaaggcgcgatcctctcgaatcgcgcctttctcatgtcccgctatctatcaactacccagcgccttcgacgccagccagaacaacccggccgacagcgcaacagtcgccggcaaggtcaacacccaagccaacagaatggtgcgaaccgtgccaccctgcaggccgctcttgttggcgaccatggtgccagccacgcccgaagacagcacgtgagtggtggaaaccggcaggctgaagatgttggccataccgataaggctggcagtagtgatctgcgccgacatgccctgggaataggtcatgccttgcttgccaatcttctcgccaatggtcagaacaacgcgtttccagccgaccatggtgcccaggcccaaggccagtgcaaccgccagaatcacccagaacggggcgtattcggtggtggtggtcaggtccttgcgcagcttgtcgaggtcagccttttcacggggttccaggccaggcagcttgcccaccttcttcgcggtgtcgtccaggcacagcaggtaacgacgcacttcgatgcggctatcggacgacagcgaatggtagtccgctacacctttgagggtgtgcagcagggcggaaatggtcggttcggtctgctgcgggttgcagcggaatttctccggcaggtcgccttccacgctcttgcccagggccaggaattcacccagcgaatcggcgttgcgctggtagaactggctcaggtgcagggtcgcgtcgcgggtgcgttcgatctgataggtggtgctgttcaggtcgagcacgaactgcgccggaacgataccgatcagcaccagcatgatcaggccgatgcctttctggccatcgttggaaccgtgtacgaagctcacggccatggccgagatcaccaggaccagacggttccagaacggtgggtgcttcttgtcgtcgatcttgcgacgctgttccggtgtcttgtgcatcttcgacagcgggcgccaccatttcaggccgatcaggatcagcgcggcgatcaggaagccagccatcggcgagaacaccagcgaggcgccgatatcgatcgctttctgccagttcacgccatctgccaacggaatgtcgttgatcagggcgttggccaggccgacaccgaggatcgaaccgatcagcgtgtgcgagctggacgccgggataccgaagtaccacgtgccaaggttccaggcgattgccgcggcgagcaacgagaacaccatcgccagaccatggccggtgttcacattgatcagcagctcaaccggcagcaagtggacaatggcatacgccacgccaacgccacccagcagcacgccgaggaaattgaacacaccggagaagaacaccgccaggtgaggcggcatggctttggtgtagataacagtggctaccgcgttagcggtgtcatgaaatccattgatgaactcgaaggcgaggacaaacgtcagggcgagcaagaggctcacaagcacccaagcatccagtccgctgaataaatcgatcatgaaggttttctgacccggtcgtaagggggcgcgattatgccagaaaagactggaaatcgatgccctacctgctcgtcggtaacaatcttcttcgatttaatttgttgcagcgcgttaaaaccaagcgtcacacagggtttttcaacctgttgattttattgggaaagcgctttttttaaggtcgcttttgccggcgcattggaggctcaaacgcttgtctgaaatatctgtgaaacctgtaggaagctccccttcaccctgtaggacggggagatagccgctgcccgcgggtagcgggcgcgcaaggcaaggtctatacaccgcgcttgtaaccggtgcgcacgcttgcccccgaagaattcaagcagcggggctcatggctcttcggctttgagttccttttcgatcttttctatttcctgcttgaacacctgatcctgaacggtggggcgtttacgccacgctttgcgttctggttcgggctgggcggcgtaggtggtgacttccccgccgtaaacttccttgtaacgttgttcctggcgctcaagttccgcgcgcagttcgtctttcgtcacagtgctacctgtttgatttgagttgaatgtctggtgaaacgcactgcaacagatcgattgagcgaccccgtcgagtgcgcaacgcctgtgcaggcattggcgtcatcgacagggcgatcaagacttccgtgttacaggcggctacggcaccagattaaaactgacgcagcatcagtttcctgtttcagcgagcgttggcgttgcatgagtaatgaacgtcaggcgctggccgggtccgacagcgatggcatcgcgtcagcgggtggcaacctcggtgattaaaacaggctgtcactgagtgcattatagcggtcgattcgggaatgactatctttgccaagttaaaaacggttccggatgtgtgatcgttttgttactcgcaacttttattactagttgaactgcaagccgagcgttatttactgaccgatctgtttttggcgccatttagtcgatcaactaagaaggttcagtttgctgctgaaattgcacaagcgtctcggttgtgcggattacggcgtaagttgcattgcgattatcggtctgtcgttcgataatcgcccaatcttggcgtcccagcccttgtgcatctgttggccagtcgcttgtatagccattgatccgtgcggtatccggaaataaggacaggaaatgaacgatcaaatgcgcaactccttcacctccgtggcgccaccgattgtcgcctcgccagccaagcggattcaggcgctgacgggcgacccggatttcatgacctcgctggcccgtggtctggccgtggtccaggccttccaggaacgcaaacgtcatctgaccatcgcgcagatcagccaccgcacggaaattccccgcgccgccgtgcgccgttgcctgcacaccctgatcaaactcggctacgccaccaccgacggccgcacctattcattgctgccgaaagtgctgaccctcggtcacgcctacttatcgtcaacgcctctggcggtgtcggcgcaaccctacctcgaccgcatgagcgagcaattgcacgaagcctgcaacatggccacgctcgagggcgacgacattctctacatcgcgcgttcggcaaccacgcagcggctgatttcggtggacctgtcggtgggcgggcgcctgccagcgtactgcacgtcgatggggcgaattctgctggccgcgctcgacgatacgtcgctgcgtgagtatctcgaccacgccgaactggtcgccaagaccagccgcacaatccatacccgcgaagcgttgctcgaatgcctgcaggaagtgcggcagcagggctggtgcatcgtcgatcaggaattggagcaaggtttgcgctcgattgctgtgccggtttacgacgcctcgggccaagtcgtcgcggcgctcaacgtcagcactcacgccggccgcgtcagccgcaccgaactggaacaacgcttcctgccgggcctgctcagcgccagccgcgacctcagtgcgcaattatttgcctgattaagctgttcgataaacgcacagtgttgcgtttatcgaattgacgctaaaacccccggatcattaatgtcgcggcagcgtcatccggcgctgatgtgaatgagcccgccggactgtcgactcccataataatgacaagaggcaactcaccatgcgcatgctccccgactgtctccgctccaaccgctgttgccgggttcgccgcaacgcctgatccagatcttctattcttgtgaccgtgccgctccttggccggccgccgttcgactgcgttttttgcgtggaataaaaataatgaaccagcctcagtccgctgtgggtaactgcctcgacgtgcagaccttcatcaatgcccaaccgatctcgcgctatcaatggcgggtggtgattctgtgtttcctgattgtcttcctcgatggcctcgacaccgccgcgatgggcttcattgccccggcgctgtcgcaggattggggcatcgaccgcgccagcctcggcccggtgatgagtgccgcgttgatcggcatggtcttcggcgcactgggttccggcccgttggctgaccgcttcgggcgaaaagtcgtactcgtcggcgccgtggttctgttcggggccttcagtctcgcgtcggcgtacagcaccaacgtcgaacaactgctggtgctgcgcttcttgaccggccttggcttgggcgcagggatgccgaacgcaaccacgctgctttcggaatacaccccggagcgcaaaaagtcgctgctggtgaccagcatgttctgcggcttcaacctcggcatggccggtggcgggttcatttccgccaagctgatcccggcgttcggctggcacagcctgctgctgattggcgggatcctgccgctgatcctcgcggtggtgctgctgttctggctgccggaatcggcgcgctacctggtcgtgcgtaaccgtggcaccgacaaggtgcgcaagaccctggcgccgattgatccggtcaccgtcgctcaagcctccagtttcagcgtgcctgaacagaagaccgtcaaggcgcgcaacgtgtttgcggtgatcttctccggcacttacagcaccggcaccttgctgctgtggctgacctatttcatgggcctggtgatcgtctacctgctgaccagttggctgccgacgctgatgcgtgacagcggcgcgagcatggaacaagccgctttcattggcgcattgttccagttcggcggggttttgagcgcggtggctgtgggatgggcaatggaccgcttcaatccgcacaaggtcatcggcattttctacctgttggccggggtgtttgcctacgcggtagggcagagccttggaaatatcaccttgctggcaaccttggtgttggtggcggggatgtgcgtgaacggtgcgcaatcggcgatgccgtcactggcggcgcggttctatccgacccaagggcgggcgactggtgtgtcgtggatgctggggattggccgctttggcgcgattctcggggcatggatgggcgcgacgttgctggggttgggctggaatttcgagcaggtgctgacggcgttggtgattccggcggcattggccaccacggcggtggtgatcaaaggcatggtcagtcatgcggatgcgacttgagtatcagcgcatgatcgttcccacgctctgcgtgggagcgcctctagggacgctccgcgttccggcctttgaaagggacgcggagcgtcccgggctgcattcccacgcggagcgtgggaacgatcaaaacacgaaccgataggctgacaacaatctgttcgataaacgaacactcagtcgattatcggattgtttggccagttccccaggcttaatctgcagtgactccggcgctgaacctcgcgcctttttatcactggcgattcattacaaaaacaggagcccgctccatggctgagatcctttcgctgcacgacgcggtgaagcaattcgtcaacgacggcgacaccgtcgcgctcgaaggctttactcacttgatccctacggctgcgggtcatgaaatcattcgtcagggcaagaaagatctgacgctggtgcggatgacgcctgacctgatctacgaccaactgatcggtgccggttgcgcacgcaaactgattttctcctggggcggcaacccgggcgtcggttcgctgcatcgtctgcgtgacgcggtcgagaagcaatggccgcacgcgctggaaatcgaagaacacagccacgctgacctggcgaatgcctacgtcgccggcgcttccgggctgccattcgcggtgctgcgtgcctacgccggttccgacctgccgaaggtcaatccactgatcaaaaccgtgacctgcccgttcaccggtgaagtgctggcggcggtgccgtcggtgcgcccggacgtgaccgtgatccacgcacagaaagccgaccgccaaggcaacgtgctgctgtggggcattctcggtgtgcagaaagaagccgcactggccgccaagcgctgcatcgtcaccgtcgaagaaatcgtcgacgatctcaacgcaccgatgaactcgtgcgtattgccgacctgggccttgagcgcggtctgccacgtgcccggtggcgcacatccgtcctacgcccacggttacaacgagcgtgacaatcggttctatcaggcgtgggatccgatcgcccgcgaccgtgagacgtttaccgcgtggatcaacgaatacatccatggctgcgctgacttcagtgcgttccaggccaagttggccgctgcttcggaggccaagtaatgacttacaccaccaatgaaatgatgaccgtcgctgcggcccgtcgcctgaagaacggctcggtgtgcttcgtcggcatcggcctgccgtcgaaagccgccaacctcgcgcgcctgacctcgtcgccggacgtggtgctgatctatgagtcgggcccgattggcgccaagccaagcgtgctgccgctgtcgatcggtgacggtgagctggcggaaaccgctgacaccgtcgtgccgaccggtgagatttttcgctactggttgcagggcgggcgcatcgacgtcggttttctcggcgccgcgcaggtcgaccgtttcggcaacatcaacaccaccgtggttggcgattacttctcgccaaaagtgcgtctgccgggtgccggtggcgcgccggaaattgccggttcggcgaaaagcgtgttgatcatccttaaacagtcggcgcgttcgtttgtcgacaagctcgatttcatcacctcggtcggtcatggcgagggcggcgattcgcgcaaacgtctgggcctgccgggcgccgggccggttggcatcatcaccgacctgtgcatcatggagccggaagagggcacccatgagttcgtcgtcaccgctttgcatccgggcgtaacccgcgagcaagtggtcgcggccaccggttgggcgatccgttttgccgaacatgttgaaaacaccgctgaaccgactgaagtcgaactgactgcactgcgcgatcttgaagcgcgcaccgccgcggcccacggccaggcaccgggagaagcatgatgcgtgaggtttatatttgcgacgcgattcgcacgccgatcggccgtttcggcggcggattgtccgccgttcgcgccgatgacctggccgccgtgccgatcaaagccctgatggagcgcaatccatcggtggactggagcgccatcgacgaagtgttcctcggttgcgccaaccaggccggcgaagacaaccgcaacgttgcccgcatggcgctgctattggccggcctgccggacagcgtaccgggcgtgaccctcaatcgcctctgcgcttcgggcatggacgcgatcggcactgcattccgtgcgattgccagcggcgagatggagctggcgattgccggcggcgtcgagtcgatgtcccgcgcaccgttcgtgatgggcaaggctgacgcggcgttctcgcgcaacatgaagctggaagacaccaccatcggctggcgtttcatcaacccgttgatgaaggcgcagtacggcgtcgacgcgatgccgcagactgccgacaacgtcgccgacgactataaagtctcgcgcgaagaccaagacgcgtttgccttgcgcagtcagcaacgtaccgccgccgcgcaggccgccggctacttcgccgaagaaattgttgaagtgcggattgcccacaagaagggcgaaaccgtggtcagccaggacgaacatccgcgtgccgataccacgattgaagcgttgaccaagttgaaaccggtcaacggtccggataaaaccgtcaccgccggcaatgcctccggggtcaacgacggtgctgccgcactgattctggcgtccgccgaagcggtcaaaaaacatggtctgaccgcccgcgccaaagtgctcggcatggccagcgccggtgtagcgccgcgcgtgatgggcatcggcccggtgccggcggtgcgcaaactgatcgagcgcctgggcgtcgcggtcagcgatttcgacgtgatcgaactcaacgaagcgtttgccagccaaggcttggcagtgctgcgtgaactggggctggcggacgacgccgcgcaggtcaacccgaacggcggggcgattgctcttggtcacccgttgggcatgagcggtgcacgtctggtgctgaccgcgctgcatcagctggaaaaaaccggcggcaagaaaggtctggcgaccatgtgcgtcggtgtcggccaaggtctggctttggccatcgaacgcgtctgacgccagccgtgacgaaaaagaacagaggaaagcgacatgtctgacaagcctggttaccgtcgtccgcaggaaggcactcagcctgactacctgcacccgacgtatcaatccaccaacctgcgctcgccgtcgaagccgttggtgtttctgccgcactcgctgtcggaaatcaccgggccgaccatcggcgccgaacgtgtaggcgataccgataacgacctgaccgcccagcatgagggcgagccgcagggcgaacgcatcatcattcacggccgcgtgctcgatgaaaacggtctgccggtgccggggattctggtggagatctggcaggccaacgccgccggtcgctacaaccacaaacgcgacctgcatgacgcgccgctggacccgaacttcaccggcaccggccgcaccgtcaccgacgccgacggctggtatcagttccagaccatcaagcccggcgcctacccgtggggcaaccaccacaatgcgtggcgcccggcgcatatccacttttcgctgttcgggccgagtattcttacgcgcctggttacgcaaatgtatttcccgggcgacccgctgctggcctacgacccgatctacaactgcgtgccggacacttcggccaaggaacgcctgatcgccagtttcgatctggaaaaaaccattccgtcctacgccctcggttatcgctgggacatcgtgctgcgcgggcgtgaagccacgccgatggagaaataagatgacgctgactgcgaccacgtcccacaccgtcgggccgtactaccacatcggcctgacctggctgaaccgtgaagatctcaccgttgagcagaccctcggcgagcgcgtggcgatcaccgggcaggtggtggatggcaacggcgatgtcgtcaacgacgccatgcttgaagtctggcaggccaacgccgccggtaaatacgaccacccggaagacgagcaggaaaaaccgctcgatccgaactttgaaggctttggccgtgtgccggtggatgctgaagggcgtttccgtttcaccacgatcaaaccgggtacggttgaagggctgaaaggttcgactcaggcaccgcatctggtggtgctggtgtttgcccgtggtttggtcaagcacttgctgacgcgaatctactttgaaggcgagccggcgaatgttgatgatccgttgctcgaatgcgtaccggctgaacgtcgcccgaccttgctggcgaagaaggatgaatcgggtgtttaccagtggaatgtgatcctgcagggcactgatgccgagacggtgttcttcgattattaagatcaaaagatcgcagcctgcggcagctcctacatgatcgttcccacgctctgcgtgggaatgccgccatggacgctccgcgtccaccgtgacgcggagcgtcacaggatgcgttaccacgcggagcgtgggaacgatcaacaggagaatgcagacccatgtaggagctgccgaaggctgcgatcttttgatgtttcgccttgaggaacgggactgttgcaaagtatgtctagactctcactgtccctatcgagtgaaaaacaatgacaaccaccacctcccattacaccggtgaagagcgcagcaagcgcatctttgccattgtcggcgcctcgtccggcaacctcgtcgaatggttcgacttctacgtctacgccttttgcgcgatctatttcgccccggcgtttttcccctccgacaaccccacggtgcaactggtcaacaccgctggcgtgttcgccgccggctttctgatgcgtccaatcggcggctggattttcggccgtgtcgccgacaagcacgggcgcaagaactcgatgctcatctcgattctgatgatgtgcttcggctcgttgctgatcgcctgtctgccaacctataaggacatcggcgtctgggcaccggtcctgctgttgttcgcacgcttgctgcaaggcctgtcggtcggcggtgagtacggcaccaccgcgacctacatgagcgaagtcgcgctcaagggccagcgtggatttttcgcctcgttccagtacgtgaccctgatcggcgggcaactgctggcggtgtcgctggtagtggtcctgcagcagttcctcagcgaagaagacctgcgtgcctacggctggcggatcccgtttgtggtcggtgcggtggcggcgctgatttcgctgttcctgcgtcgttcgctgaaagaaaccaccaacaaggaaactcgcgaacacaaggacgccggcagcatcagcgcactgttccgcgatcacaaagccgcgttcatcaccgtgctcggttacaccgccggtggttcgctgattttctacaccttcaccacctacatgcagaagtacctggtgaacaccgccggcatgcacgccaagaccgccagctacatcatgaccggcgcactgttcctgtatatgtgcatgcagccgctgttcggcatgctcgccgacaagattggccgccgtaattcgatgctctggttcggcgcgctcggcacgctgtttaccgtaccgattctgttgagcctgaaaagcgtcagcagcccgtttctggcctttgtgttgatcaccgtggcgctggcgattgtcagtttctacacctcgatcagcggcctggtgaaagccgaaatgttcccgccggaagtccgcgccctcggcgtcggtctggcctatgcggtggcgaatgcgatcttcggtggttcggcggaattcgtcgccctgagcctgaagaacatcggcatggaaaactccttctactggtacgtgacggccatgatggcgatcgccttcctgttcagcctgcgcctgccgaaacaggcggcgtatttgcaccacgatctctaacccgatgcgcgcgggccgtgatggcccgcgccggcaaggacttttatgactcagcgaccgggcaatcaattgttcgatgcctacttcactgcccgcgatatgcgcgaggtgttctgcgatcagggccgcgtgcaggcgatgctcgacttcgaagcggcgctggctcgggccgaagcgcgggtcgggttgattcctgcctctgcggtggcaccgattgcggcggcgtgcagcgctggtctgtatgacttcgcggcactgggcgaggcgattgccacggccggcaattcggcgattccgctggtcaaggcgttgggcaagcagattgccgcgaccgatgcgcaagctgagcgttatgtgcatttgggcgcgaccagtcaggacgtgatggattccgggctggtgctgcaattgcgtcaggcgctggaattgattgaaagcgatctggcgcaactggctgactctctcgctgttcaagcacaacgccatgcagcgacaccgctggccggacgcacttggctgcaacacgcgacgcccgtgaccctcggcatgaaaatcgccggatggctgggcgctgtgactcgcagccgtcagcgcttgcgcgaactcaagccgcgtctgctggtgctgcaattcggcggcgcctccggcaccctcgcggcgctgggcgaacaggcgctgccgattgccgaagcgctggctgaagaactgcaactgaccttgccggaacagccgtggcacacccagcgcgatcgcgtggtggagttcggcgcggtgctcggtttgatcgccggcagcctcggcaagttcggccgcgacatcagcctgttgatgcagactgaagcggctgaggtgtttgagccatcggcgccgggcaaaggcggttcgtcgaccatgccgcacaaacgcaatccggtcggtgcagcggtgctgatcggcgcagcgacgcgggtgccaggtctggtctcgacgttgttcagcgcgatgccgcaggaacacgaacgcagcctcggtctgtggcatgccgagtgggaaaccctgccggaaatctgctgcctggtgtcgggttcgctgcaacaggcgaaattgctcgctgagggtctggaagtcgacgctgagcgcatggcgcacaatctcgaactgacccaagggctggtgctcgccgaagccgtgagcatcgtcctcgcccagcgtgtcggccgcgacactgcgcatcacttgcttgagcaatgctgcaaacgcgcggtggccgaacagcgccatttgcgcgccgttctcgctgacgaaccgcaagtcaccgctgaactgagcagcgctgaactggatcatcttttgaaccccgcccattacctcggtcaggcgaaaacctgggtcgagcgtgcggtggccgaacacaacgcattgtctgtctgaaaggagagggctgtggctttcgttcaactcgccgatggcgaactgcactatcaaatcgagggcccggtcgatgcgccggtgctggtactgtccaactcgctgggcactgatctgcacatgtgggacgcgcagatgccggcgtttaccgagcattttcgcgtgctgcgtttcgatactcgtggccatggcaagtcgctggtgacgccggggccgtacagcatcgaacaactcggtcacgacgtccttggtctgctggatgcgctgcacatcaagcaagcgcatttctgcggattgtcgatgggcggcttgatcggccaatggctggggatcaacgccgggcatcgtctgcacaagctgatcgtctgcaacacggcagcaaaaatcggcgatccgtcggtgtggaatccacgcatcgaaaccgtactgcgtgacggtgcggcggcgatggttgccctgcgtgatgcgtcgatcgcccgctggtttaccccagatttttccgctgcacatccggccgcagccaagcagatcaccgacatgctcgcggccacttcgcctgagggttacgcggccaattgcgcggcggtgcgtgatgccgatttccgcgagcaactggcttcgatcaacgtgccgttgctggtgattgccggcaccgaagatgcggtgacgccgccggccggtgggcatttcattcaggagcatgtacgcggtgccgagtacgccgagttctatgcggcgcacctgtccaacgtgcaggctggcgcggatttcagtgatcgtgtgttggcgtttttgcaggctaagtgaggaagtttttgtggacgagaaacaacgttacgacgaaggcatgcaagtgcgccgcgcggtgctcggtgatgcgcatgtcgatcgcagcctgaccacgctgaccgagttcaactcggagtttcaggaaatgatcacccggcatgcctggggcgatatctggacgcgtccgggcttgccgcggcacacgcgcagcctgatcactatcgcgatgctgattggcatgaaccgcgaaggtgagctgaaactgcacctgcgtgcggcggccaataatggtgtgagccggggcgagatcaaggaagtgatcatgcagagtgcgatttattgcgggataccggcggcgaatgcgacgtttcatttggctgaatcggtttgggatgagctaggagtcgaatcccgggaatagtcgttggccgggctgacgccatcgcgagcaggctcactcctacatttggaatgcgttcccctgtaggagtgagcctgctcgcgatagcgatagtggccgcgacaaatcagacggtggccacaataaatatccgcttgaacgcaaacaacgtatgcccatcgctctcctgcggataatgcttatgcacccgcatcagatagtgataaataaaccgcgcctgttccgcagaatccagcgcctgcatcaccggccgcagcgccgaaaccttcacccagtcgtacaccggtgatttgccgtcgactacctgcaattgctcggtctcccagatatccagcgacgaggtcagcggcgcgagcaagcggtagtaatcctccagcgccaacaacggccgcgccgccatgcgctgacgcagctcaggggtgcccatcggcgtgccaccgggaccgccgtcttcgagggtgtcgagcatcagccgataccacagcgcatcgcgccagtccggcatgtgcgctgccagacaaccgccgggattcagataacccagcagctgcggcagcaacgtttcatggccatcgataaagtgcagcacggcggcggcgagcagcaggtctgccggctgctccgcttgccaatcgagcagatcgcagtgtttccacgatgccctgatcggcaggcagcgcgcttcatcgagcatctgcgtggagctgtcgacgccctgcaactgcgcgcgcggccagcgttcggccaacaactgcgtggcaatgccggtaccgcagccgagatcgtaaatgcgttgcgggttcggcaggtcgactctttcgagcagttcagtgaccggtcgctgtctgagacgggagaactgctgatacgccttggcgtcccagtgagtggctttgcctgccgtgtcgagtttgacgctcatgaggtgatcctctctggcgaattacaatagtcttcccatgacattcagggttctcaggacaactgccacacctttgcgtgtgtccggttcgttgaacaatttgagcagggcaaagaggctgggcggttcggccagtgccaaagtttcagcttttgccacacgaactgcgttgctggctgcccaggtggttgccgcagcggtttcgaatagttgcgccagtttttccaccattgccgcatccagcagatcggcgatatctgaaaccagtgacagcatgtcgacgatattttctaggcgtccgccgtcgatcaacggctgcaacttggccatgagggctgtgaacccgggggtggccgacatttcttcgggcatgttcatgagcaatcactcctccctgtgcagggtcaaagcattccccgggcaaccgcccagtacagaccacgattgaatccgtttctgagcaggccccccagtctggtcggcggggttggcaacacatcgtgggtgtagtcataccagagcggcatcccggcattgaggcccatttgtgccacggcttgtactcgaccgtcgtagaccgtgttgggggcaccgaagcgaacttcggcggcgatgttgttggcaatcaccggcgcctggttatgacaggcgccgccggccttgctgacaggcaggtcaacggtgtcgccgatcacgtagacattctccaggccgtaaacctgcagcgtttcatgatgggtcggcagccagccctcgttattcggtgcctgtgaggcgcccgattccagcaccgcatcgacggcccgaatcggtggggtcgccatcaggatgtcgaaaggttgcgcatcgccctcggcggaataggcgatctttgcttcaggatcgacatggctcagggtgaaaccgcgctgaaagtgaatgtttttctgctcaaaaatactcggcagaatttcaccggtcgggcgttgcaagaacaggcaattgcgcaggagttgggcgacggtagggtaggtgtagatgatttccacttgttcgcgaacaccccggcgccgcagtaaatcatccagcatcaatgtcgtttccacgggagcgataccgcattggtgcggaacattcggcgtctgcggaaatgacacggtaatgaaaatccggcctttttggatggtgttcaggcgttgcgccagttgccgggcggggaggtattgatagaagtggtctcctgcctctttcaggccgtcaatgcgttccggtgccggcacgcagcctgtagcgatgatcagaaaatcatagtcaaagcgtttgccgctgcgggttttcaggtgctgggcgctaaagtcgaagcgtgtcacttcttcgacgataaagcggatttccgggcgcaacagtgaacgttccgggcgtgtgagttcttcctcgaagaactgattgaacgccacgtacatgaacgcaggtttgtagtagtgatcgggagagttggacagcagcgtgatcgagacttcgttgcgcaggacttctggatacaacttgctgaccaactggttggccaacatggttccaccgacgccgccaccgacgataactattcgcttgctcatacctgacctccagggtcatggcagcttcgcgtacagcatccggagataacggaagagaaaagggctcctacatcggactggagaatgtaaccactgtttgactctatccatgttggcaaaatccgccagcccgaagcgaccggcggtgttgcttgatcgatggcttttttggcacgccagtcgggtgttacaacagactgatcgggtagctgacgatcaggcggttttcgtcgaattcgttgttgctgaagtcgcggcgcatggtcgagttgcgccatctgacgttcagatccttgagcgcgccgctctgcacggtataacccagttccgattcgcggccccattccttgccgttggtgatcgtcccggtgtgtacattgtcgccgctgatataacggttcatcagggtcaggccgggcacgcccatggcggcgaagttgtagtcgtggcgcacttgccaggagcgctcctgcgcattgtcgtagctggcgttgtaactgtcgttggccaaggtgccgccgctggtgccattgacgcgcatccatgcgctgtcgccggtaagtttttgcaggccgacgtagaaggtgttgccgccgtatttggccgagaacatgccggaccaggtcttgttgtcgaggtcgccggcgcgggcgctgccatcgtccttgccgtagaagaagccaaggttggcgccgagggtccagtcgccgagtggttggctgtggatcaggttgacgtattgctggctgtagatgtctttgagttcagcgttccacaaaccgatctgcgtgcgtttttcgttgaaaacatactcaccgccctgaaagttgaatcgatcagaggtgaacgccgctttgccggtcatcgacatgtcgctcatgctgctgtcgtcgcgcgggctgttggcgcggaactggccgccgtagagggtcaggccgtcgatttccttcgaggtgatctgcccgccacggaaggtttgcggcagcgagcgaccatcgtctgaacgcaggatcggcagcaccggcatccactcgccgactttcacttcggtctgggaaagcttggctttgaaggcgacgttggtgcggccgaagttgtccgccgggcgaccgtcgtgatccagcggcagcaactgcgtgccacccgtgcctttaccgccatcgagtttcaccgaatacaggccgagcacgtccatgccgaaaccgatggtgccttgggtgaagccggacttggcgtcgaggatgaagctctgcgtccactcttctgctttgccctgagccttggtcgggttggtgaagttgcggttgatgtagaagttgcgcaggttgaggttgaccttggccccttcgatgaaaccggcctcttcagccgcagcgggcatcgccgcgccggccagggccagggcgatcagaccgggaaatgcgtaaggcgcaggggaggttgtcatagctggggtctctcttgtttttttaaggcgaacgggggcgctgccaccggttttcggggtgcagacatgaaaagtgttcaggggtgaaacgaaggcaatcagccggacggggcagggcgcgggagcatggtgtcgaacctgttgttattggttttgtggagcgaatggtgcggggcgcggatgttttgattcaattggtaaaagcgggttttgggcgattatcgaacgcaagattcagttggattttatagtgtctgtgagggcctcttcgcgagcaggctcgctcccacaggggatcgcattccaaatgtgggagcgagcctgctcgcgaaggggccagcccagacaccacaactttcagacaggcaacaaaaagcccaccaatcggtgggctccttgtattcagccgatgatgatcagaacaacttcatcttcggcgcttcttctttcagcggttcgttctgcgcggtctgcgcattccagccaccacccagggccttgtacaggttgaccgcactggtcagctgcgcgaggcggtcggtgatcagcgcttgttgcgcgctgaacagctgacgctgggcatcgaggaaggtcaggttgctgtcgacgccgatgcggtagcgacgttcggccaaacggtagtaatcctggttggcctgaacgaagtcacgctgcgcttgcagctgttcggtgtaggtctggcgtgcggccaggccgtcggcgacttcctggaaggccgtctgaatggacttctcgtagttcgccacgccaatgtccttctggatcttggcggcgtcgaggctggcgcgcaggctgccggcgttgaagatcggcaggttgatctgcggctggaacagccacgtccccgaaccacccttgaacagaccggacaggtccgggctcaggctgcccgcgttggcggtcaggctgatgctcgggaagaacgccgcacgggccgcgccgatgttggcattggccgctttcaggttgtactcggcttgcaggatgtccggacgacgttgcagcaagtccgaaggcagacccggcggtacatcgctgagcaggtcatccgacagcggtttggccgcttgcagattggccgggataccggtgccgagcagcagcgtcaggctgttttcgtcctgtgcgacctgacgggtgtaacgcgccagttgtgcacgggcgttctcgaccgaggtgcgcgattgcgccagatccagcgccgaagccacaccgacttcgttgctgcggctggtcagcttgtagctttcttcgaaggcaccgagggtgtcttgcgtcagcttgagcagttccttgtccgcttgccaggtcaggtaagcattggcgacgctggcgaccagactgatctgggtgctgcggcgtgcttcttctgtggcgaagtattgttgcagggcctgctcgctcaggctgcgcacccgaccgaacaggtcgagttcgtaggcgctgatgccgacggtggcggaatacgaactgctgatcatcgagtcgcccgtcgtcgacgcgcgagccggcagacgttgacggctgccgctggcattggccgaaacggccgggaacaggtcggcacgctggatgcggtattgagccgcgtaagcatcgatgttcagcgccgcgacacgcaggtcacggttgttttccagggaaacctggatcagctgttgcagcgccgggtcatggaaaaactgcttccagccctgctcggcagcggcctgcgccggagcctgggccggcgaatacgccggcccctgtgggtactgacctgcgaccggagcctcaggctgctgatagtcaggtatcagcgagcaaccgctcagcacgaaggcggcgactgcgatggagagtagcgacttgctcattggccagcctctttaggagtttcagtagtctcatcctcgtcagcgatcttacgctggccgatggacgaaaccgtaacgaagaacagtgggacccagaagatcgccaggatcgtggccgtgagcataccgccaatcacacccgtaccgatcgcatgttgactgcctgaaccggcgccagtggagatcgccagcggtacaacaccgaggacgaaggccagcgaggtcatgatgatcgggcgcagacgcatgcggcaggcttcgatcgccgcatcacgcaggctacgcccttgttcatgcaattctttggcgaactcgacgatcagaatggcgtttttagccgccagaccaatggtcgtcaacaggcccacctggaagtacacgtcgttggacagaccgcgcaggctggtggccagcagcgcaccgatgatccccagcggcaccacgagcataaccgcgatcggaatcgaccagctctcgtacagcgccgccagacacaggaacaccatcagcagcgacagggcgtacagcgccggcgcttgcgaacccgacagacgttcctcataggacagaccggtccaggagataccgacaccggccggcagcttcttggcaatcgcttcgacttcggccatcgcttcaccggtggaataacccggcgctggcgaaccgagcacctccatcgcttccacaccgttgtaacgggccagcttcggcgaaccgtagatccactcgcctttggcgaaggcggagaacggcaccatggtcccggcgttgttgcgcacgtaccatttcttcaagtcttcagggctcatgcgagcaccggcctgaccttgcacgtagaccttcttcacacgaccgcggtcgatgaagtcgttgacgtagctactaccgaaggagatcgacagcgtgctgttgatgtcggtgaggctcaagccaagggcctgggctttctcgtcgtcgatttccaggtggtattgcggttcatcgttcaggccgttcggacgcacctgatagagcactttgctctgcgcggcgaggccgaggaactggttacgcgcttccatcagtttgtcgtgaccgataccggcgcggtcttgcaggaacacgtcgaaaccggtggcgttacccaactccagtaccgcaggcggggcgaaagcgaacaccatggcatcgcggaaagtgaagaagtgttgctgggcacgttgggccagggcaaacacgctgttgtccgcgttacgctcgtcccacggcttgagcatgatgaacgccaggccagagctctgaccgcgaccggcgaagttgaagccgttcacggtgaacaccgaggacactgcgcctgcttctttatccagcaggtagctgcgcatttcgtcgatcaccacctgagtacgctcggcactcgaaccggccggggtctgcacctgggcgaacagtacgccttggtcttcttccggcaggaacgcggttgggatgcgggtgaacagccagatcatgccgaccacgatcagcagataagccagcaggtacggcgctttgcgcgacagcatgttgccgacaccgcgctcgtagctctgcacaccacggtcgaaattgcggttgaaccagccgaagaaacccttcttcggcgtgccatgctcgcctttcggaatcgccttgagcatggtcgcgcacagcgccggggtgaagatcagcgcgaccagtaccgacagggccatggccgacacgatggtgatcgagaactgcttgtagatcacaccggtggaaccgctgaagaacgccatcggcagcaataccgccgacagcaccagcgcgataccgaccagtgcgccctggatctggcccatggatttcttggtcgcttccttcggtgacaagccttcttcgctcatcacccgctcgacgttttccaccacaacgatggcgtcgtccaccagcaaaccgatggccagcaccataccgaacatggtcagcgtgttgatgctgaaaccgaacgccgcgaggatgccgaatgtaccgagcaataccaccggcacggtcatcgtagtgatgacggtggcgcggaagttctgcaggaacaggaacatcaccaggaacaccagcacgatcgcttcgaccagggtttcaaccacacctttgatcgactcggtcaccaccggggtggtgtcgtacgggaataccacttccatgccttccgggaagaacggcttgaggtcgtcaatcgtcttgcgcagggctttggcggtgtcgagggcgttggcaccgttggccagttttaccgccagaccagaagccggactgccgttgaactgcgcagaaatgctcgagttttcaccgcccagaccgacgtcagcgacgtcgccgacacgcacttgcgagccgtcctggttaaccttcagcagaatcgccttgaactgctcggcagtctgcagacgggtcttgccgatgatcgtcgcgttcagttgctggcccggcaatgccggcaagccgccgagttgaccggaagacacctggacgttctgtgccgagatcgcggtgctgacatcgcccggggtcaagttgtacttgttcaacttggccgggtcgagccagatgcgcatcgcgtactgggcaccgaagacctggaagtcaccgacaccggcggtccgcgagatcggatcctgcatgttcgacacgatgtagttggacaggtcgtccttggtcatgctgccgtcacgcgataccacaccgataaccaggaggaagtttttcactgccttggtcacgcggataccttgttgctgcacttcctgcggcaacagcggggtagcgaggttcagcttgttctgaacctgtacctgcgcggtgtcggagttggtgccttgctcgaaggtcgcggtgatggtcatgctgccgtcggagttactttccgaggacacataacgcaggttgtcgataccgttgagctgctgctcgatcacctggaccacggtgtcctgcacggtttgcgccgaagcgcccgggtaggtcacggagatcgcaatggccggcggcgcaatgctcgggtactggttgatcggcaatttcaggatcgaaagtgccccgaccagcatgatcaccagggcaattacccaggcgaaaatcggacggtcgatgaagaattttgacatgaattactcccctttgccgccggcggctttgtcagctgcctgagcgggggccgggttcttgttgccgacattggtggcttcggacgggttgacctgaacacccgggcgcacgtactgcagcccttcggtgatcaagcgatcgcccgctttcaagccgtcttcgatcagccactggctgccgacggtgcggctggccttgagctgacgcagctcgaccttgttgtcggcgccgacgaccagtgcggtcggggtgcctttgaggtcacgggtcacgccttgttgcggcgccagaatggcggcggcgttgacaccggcctgcaactgggcgcggacgaacatgcctggcagcagggtgtgatccgggttcgggaacaccgcgcgcaaggtcacggaaccggtagtcgggtcgaccgtgacttcggagaattccagcttaccgtcgagcttgtactggctgccgtcttccagggtcagtttgactgctgctgagttttcaccggatttttgcaggcgaccgctttccagctcacgacgcagttccagcaattcaaccgaggactgggtgacgtcgacgtagatcgggtccagttgctggatcgttgccatcgcgtcggtctggccattgctgaccagtgcaccttcggtgaccgaagaacgaccgatgcggccggagatcggcgcgtacaccttggtgtaacgcacgttgatctgtgcggtctgcaacgacgcttccgattccatgcggttggccactgcggtgtcgtattcctgacggctcacggcctgctcgtcgaccagttgcttgtagcggtcggagatcgacttggtcgaacgcaggttggcttcagcgcttttcagggtcgcttcatagaccgacggatcgatctggtacagctgctggccggctttgacatcgccgccttccttgaacagacgcttgagaatgatgccgttgacctgcggtcgaacttcagcgatgcggaacgcactggtgcggcccgggagttcggaggtgagggtaaacgcttgtggttgcagggtgacgacgccgacctgagggggcggagcggccggtgccgcttcttcctttttacatccgctgagcagcgatgccagggcgacggcagtgaccagagcggtaacagctggcttgaattgcatgaagatcctcgggtcaggcgcgcaaagagcgcacaagaagtgtgtaagggtaaaaaaaggataccgggtggataagtagcttgctaagtaatatacttacgttcatggttgtttgtaaatacctttgccgcgtacccagcccgttacaaaagtcgttgcaaggtttgaaattgtaggccggggagccgatccgcgagagatcgccccctctttattcagcggatattcagccatccctgaaacatcctgtttgaggttttactgtcatggtccgtcgtaccaaagaggaagctcaagaaacccgtagccagattctggaagcggcggagaaagccttttatgaaaggggcgtcgctcgtacgacgctggccgatatcgcgacaatggccggtgtcacccgtggtgccatctactggcatttcagcaataaagcggacctggtccaggcgatgctcgacagcctgcatgagccactggatgaattggccaaggccagcgagagcgaagacgaactggacccgctgggctgcatgcgcaaattgctgattcatttgtttcatcaagttgcgctggacccgaagacccgccgcatcaacgaaattctgtttcataagtgcgagttcaccgatgaaatgtgcgatttgcgccagcagcgccgggtggccagtctcgactgcaacgagcgcatcgggctgaccctgcgtaatgcggtgaatcgcggccagttgccggaagatctcgacactgcccgcgcggccatcagcattcacgcttacatcgatggcctgctgtatggatggcttctggcgccggacagctttgaactgcatgccgaggctgagcgttgggtcgatacagggttggatatgctgcgcctgagccccagcctgcgcaaatgaaacaaaatgcgtaattggcacagcttatgtcaattggcctgcctttacatacgtttgcggcggggagtttaaacgtagcgagctaggcattttgtagggaatttgtgtcgtctgtgtgaatgagtgtgagccgcttgccctcaccctagccctctcccagagggagaggggactgagcgaggtgttcttgcgagttacaccgacgtgagatatcagggccaaactccagatttgaatagcacacagatcagctccctctccctcgggagagggttgggcgggcggcgttccgatgaggggctacgtaacaagccgcgcaatcactctcaggcgaacacaaaaaagcccccaactctcacaagtcgggggcttttgcgtttctgtgtgttgcctattacagcgccgggtagtcgatataaccgaccggccctttaccgtagaacaactccggacgcgcatcattcaaaggcgcatccgccttcaagcgcgccggcagatccgggttggcaataaacggcacaccaaacgccacagcgtcagccttgccactggccagccattcattggcgctgtctttggtgaacttttcgttggcaatgtacgggccaccgaacgcttctttcagttgcgggccaaggctgtcggcgccttctttctcacgggagcagatgaacgcgatgccgcgtttgcccagttcacgtgcgacgtaagtgaaggtttccgcaaggttgtcgtcgcccatgtcgtgggagtcagcgcgcggtgccaggtgcacaccgacacggccggcgccccagacttcgatcgcagcgtcagtcacttccagcagcagacgcgcacggttttccagcgagccaccatagttgtcggtgcgctggttggtgctgctttgcaggaactggtcgagcaggtaaccgttggcgccgtggatttccacgccgtcgaaaccggcggccttggcgttctcggcaccggtgcggtaggcgtcgacgatgtcggcgatttcagcggtttccagtgcacgcggagtcgggtagtcggccaatggacggaccaggctgacgtgacctttcggctggatggcgctcggtgccaccggtgcttcaccgttgaggtacgaagggtgggaaacccggccgacgtgccacagttgcaggaagatcttgccgcccgcgccgtgaatcgctttggtcacgttggcccagccgcgcacttggtcgttggaccagatgcccggggtgtccgggtagccaacgcccatcggcgttaccgaagtggcttcgctgaggatcaggccagcggacgcgcgctgtacgtagtattcagccatcagcgcgtttggcacgcgaccttcgtcggcgcggcagcgggtcagcggggccatgatgatgcggttggccagctcgacgtcgccgagtttgatcggatcaaaaatagttgccatgtctacaaccctcgtaagtgaaaagttaatcagtgagtagcgggggccagatcggcgttgccgttctgacggaaagtgatcagggtcaccagcagggcgagcacggccagggcggcggctgcgagcggcacgctggtcaggccgtagccgtgggcgatgacgctgccaccaacccaggcgccgagagcattgccgacgttgaaggcgccgatgttcagggtcgaaaccagattcggtgcagccttgccgaaggtcaccacgttgacttgcagcgccggcacggcggcaaaacacgcggtggcccaaaggaacagggtgatttcggtcgggatcagcgcgacgctggtccaggtcagcacggtggaaaccacggccatcgcaatgaacacgccgatcagcgtggcggccatgcctttgtcggcgagcttgccgccgatgatgttgccgacggtcaggcccaggccgatcagcatcagcgtccaggtcacgccacgcggcgacacgccggtgacttcaccgagcagcggggcgacgtaggtgaacagagtgaagacggatgcggcgaacagtgcggtcatgctcagcgacagccagatccccgcacctttaagggcggcgagttcggcgcgcatgtcgagtttttcttcatcacgcttggccggcaggaagcggatcaggccgatcagcgcaatcacaccaatgacggtcaccgcccagaaggtcgagcgccagccgtattgctgacccagcgcagtgcccagcggtacaccgaggacgttggccaaggtcaggccggtaaacatcaacgccaccgccgacgcacgcttgttggccggcaccagattggccgccaccaccgaaccgataccgaagaacgcaccgtggcacagcgcggtgatcacgcgggcaaacatcagcacgttgtaatcgctggcgatggcgcagagcaggttgccgacaataaaaatgcccatcaacgcgaccagtgctgctttacgcggcaacttggcggtggccattgccatgaacggtgcaccgattgccacgccgagggcgtaaccggtcaccagccagccggcgccggggatcgacacaccgaggtcggccgccacatcgggcaacaggcccatgatgacgaattcggtggtgccgatggcgaaggcgctcaaggcgaggatgagtagcgagaggggcatgcgtgtttccttgtcggctggctgacgttaagggtcagagctctttactgagggtgctgaggaacgcctggatcacgtcctcgttacgtttgaaaaaatgccactgaccggccttctggctgctgatcagaccggcgcgttgcaacgttgcgaggtgcgcagaaacagtcgactgcgacaggccgcagcgttgatcgatctgcccggcacagatgccgtactcgtggttgtgcaactgttccggaaattcgttcttcgggtctttcagccagttgaggatgtctcgccgtactgggtgcgccagggcttttattatttcgtcgaggtcgaggttcatggcaggtgctcacaatgtgtacaacgctatatcgcgatgtggcgaaatataaatcgttagatcgcgatacaccaatatgattttgatctgacgtcagcataaattggtatatcgcgttataacgatacaggggtgtatggcttatgggccgcagtgctaagctgcgcccatgaactatctcgcacatttacacctcggtggccagcgcccggggcaactgctcggcagtctgtatggcgatttcgtcaaaggccggctgcaagggcagtttgcgccggaggtggaagcggcgattcaactgcatcgccgaattgacgtatttaccgatcgccatccgttggtggacatcgccttggggcggtttaccgagacgcggcggcgttatgccgggatcgtgctcgatgtgtttttcgatcattgcctggcgcgggactggaagctgtatgccgagcagccgctggaggttttcaccgctgatgtgtatcgggtgctgacccacgagcggcaactgcccgaccgcctggcgaagatcgccccgcacatggtcgccaatgactggttgggttcgtatcagcagtttgaagtgctggagcaggtactgcgcgggatctcgcggcggttgagccggcccgaggaactggcgggggcgatgcaggaattgcggcggttgtatgagccgttgagtgaggatttcgctttgttttacccacaacttcaggacttcgcacaatccccccagacatcgcagatctaatgtgggagtgagcctgctcgcgatagcggtacatcaggcaacatcgatgtgactgacccaccgctatcgcgagcaggctcactcctacaggggatttgtgttttcaggcggcaatcaattcgcctgcacgacgcggttcggacggtttcgccacctcgccaaacaacgccttctgcaccgcttgctgcgcttcaaacgccagcgccgcacgctcacgcccctgacagaccatcggcttgagcaggtgcacttcgacatcgccgcaatcgttgctgaacaggcgcatcaggtgcgacagcagatcatcgtcaccaatgaacggtgccagcccatcgatctcgccatcacgcagataacggatcgccaccggttgcagcatcacttcggaatcaatcgccgccgccagcaagcgaccatgaaaggtacgcagtgagcggccatcggtggtggtgccttccgggaacatcagcagcgggtgagcggtttgcaggtgacgggtcatctgcttgcggatcaactggctgtcgcccgaaccgcgacggatgaacaggctgccggccttcgcggccagccaaccagccaccggccaggtgcgcacttcagccttggacagaaacgacagcggcgtgagcatcccgagcagcggaatatccgtccacgacacatgattgctgacccacagcatcggctgtttcggcaactcgccatgaaccgtcacgcgaaagggcagggcattgctcaggcgcgccatgaagaagcgcgaccagcgctggcgccgctccatcgaatgcgccagaccgatgcgttcaaacacgccgaagacgctggccatggtcaaacccagcgacaccaccagcagcacccgcgcgatccgcgcgtacacccgcaaccggctcatcacacggccgccttgaagtgcttggcgtagcgcgggcagagttcgtcgcgcttgagcaggatgaacacgtcggcgacctgaaagtcttcgtcccagcacggctccccgcagatcttcgcgcccagacgcatgtaagccttgagcagcggcggcatttcggcgatcacgttcgacggaatatccagcgtcggcagcggatttttcggctcggcacgcaggtgctcggtgcacagatagcgttcgcgcaaacgctgcatgatcgcgtgggcctgaatgccgccgtcctgcatcgggatgctcgcgcaacccatcagatagctgtagccgccctgattcagcacttcggccaactcgccccacaacaccgcgatggtgccaccgttgcggtacgccgggtcgacgcaggtgcggccgatttcgaggatcgggccttgcagatgcgcgaggccgtgcaggctgaattcttcttcgctgtagaacttgccgaggctgctggcggcggtgtgatcgagcaaacgggtggtcgccaccaagcggccggtgttcaaatcacgcacgccgatgtggctgcagtgaacatcataatcatccatgtccagacccagttccgcgcctttcagtttggcgttgaactcgccgctgaagacgttgaatcgcagggcctgggcttgctgcaaggcctcggcgccgatcaggcgttcggcttgcaggcggcgttcattgccggtgtcgctgatgcgggcgatctgagtcatgtgaatctccgtacgggcctttaacccgtcgtgggttgcagccgatcgactttctttatgcagccgtgttgtgcaaagtcaggctatgtagccccggtgtcatcgccatgaacgttcggtgatgcttatatgacagcccacaaggagcctcttatgccctggccagatctgctgcacagccgtgaacgattgcccgccgtcgctgacctcgccgagggttttgcgacgttgttgcagcagttgggcaacgtcacgccgttggaattggcggtcgccggcgggcggcgggcggcgacgccggggctggcgtttctggtcggttatcaggcggcattgcgcatgctctggccgagcgcgccgctgagcctcggtgcgttgtgtgcgaccgagcagcgcagtctgcgcccggcagacatgcacacgcgcctcagcgatttacgcttgagtgggcgcaaggatttcgtcactgccggcgatgcggcggactggctgctgattgctgcgcgcagcgaagaacccggtgaaacgccgcgcctgagtctggcggtggtgtaccccggcgaatccggcgtgaccgtggaaaaactgccggcgctgccgttgatgccggacatcagtcatggccgcttgctgcttgatggcgcgttgtgcgagttgttggcgggggatggttgggatgcttacgtcaaaccgtttcgcacgctggaagatgtctatgtgctgagcgcgatgaccgcgtggctgtatggcgtcgggcgggacagcgattggccgcagacgctgcagttgcgcctgctggcgctgttggccgggtgcgctgaggcgagtcggcaaccgccgaacaatccggctgggcatgtgttgttggctgggttgtttgtgcagtttgattcgctcaaggctgaggttgatcaggcgttggctgacgggccggcagaatgggcgcagatgtggcaacgcgatcaaggcgtgatgcagttggcggcgggggctagggccaagcggttggccaaggctttggcggcgggctgaagggtctcatcgcgagcaggcgaaggcctacagttgattgagtttcgtcagttgaaatgcgatcccctgtaggagtgagcccgctcgcgatagcaatctaaataacaccgcatacttgtcataaacccagactagtctcagcaggttcattcccagagccctccccatgtgcaaaggcctgtcgctgttcctgctgctgatcagcttcaccgtccacgccgaacaatggccgggtaacgattggccaatcggcacgacgatcaccgataccggggcgttggacagttacctcttcccgccccgcgacgatgcaacccgcaaaggcatccgcaccgatgccctgctgatcatccacgacggccagattatctatgaacgctacgccggcccgaccaccgaacataccccgcacctgacctggtcgatcagcaaaagcctgatggccaccgtgctcggtgtggcgtacagcgaaggcctgttcaaactcgaagacccggccgcaaagttttacccgccgctggcaaaacacccggatataaaattcgccgatttgctccattgggcttcgggcatcgactggcaggaagactacgaatacgcgccgctgaaatcctcggtggtggcgatgctctacacccgaggtcatcgcgacatggccgcgttcactgccgagcaagacagctacgctgagccggggcaggccttccgttactccagcggcgacagcaatctgctcgccgccgcattgaaaaacatcgtcggcccgcagcgttatcccgactatccgtggacagcgctgtttgagcctttgggcatccggcacgccgtgtgggaaaccgatgcgatgggcacttttgtcgcttcgtcttacgcctatctcaccgcacgggatctggcgcgagtcgggctgttgatggcccgcgacgggcgttgggatgaccagcagttgctacccaaggattggctcgcgttcaacctgcaaccgttcgccggttacaaggcccatcaggacgaagccgtgcccggcggacagtggtggctcaatcgtgcaccggatggcacggactcttcgtggcccgacgcaccgcccgacaccttcgctgctctcggtcactgggggcaggcgttgtatgtgattcccagcgagaaactggtaattgtgcgttatgccgatgatcgcgacggcagctaccgccacaacgaattgctcaaacgtgtgctgaaggcggtgcggccatgaagcgcttcttgctgttactgctggttttgctgctcggctgggtcgtctacgagcgcgaagatctttgggctttcccggacatcatcagcgcttacaccgccaaggaatattgttcgtgccgctacgtgatgaacaacgatgccgagtattgccgtggctacgtgaaacagtggctgccgaccagcgacttcagcgatgacagcgccagtaaaaccatcaccgtcagcggcatgggccgcagcaatagcgcccagtggcaaagcgaacgccggggctgccgcctcaatccctgaccacacccaatcgtccctgtaggagtgagcctgctcgcgatggcggtgtgtcagtcaacataattgttatctgagacaccgccatcgcgagcaggctcactcctacaaggggatatgttgatcctggaagcggggttccactctgtggaaccacattcgattgtccttgcgcgcgtctcgcggttatctggcggtgagcacgacctgcctttcaacgtgtcgtgaattcattgcaaacaacaagaccgggaacacccgcgcgaggagaaccgtcatgccccgacatcagcatattctggcctggctcaacgatgtggcccgcgacctgcacgccacccgccaggacatccacgcccaccccgaactgggttttgaagaaaaccgtacctcggcgctggtcgcccgatccctcgaaagctggggctacgaagtccacaccggcatcggcagaaccggcgtcgtcggtgtgctgcgcaatggcagcagttcgcgcaaactcggcttgcgcgccgacatggatgccttgccgatcattgaaaacaccggcgccgcctacagcagtaaacatcagggctgcatgcatgcctgcggtcacgacgggcatactgcgatgctgctcggtgccgcgcgttatctggcggcgacacggcagttcgacggcaccctcacgctgattttccaaccggcggaagaaggtcagggcggcgccgaagcgatgctcgccgacggtctgctcgaacgctttccgtgcgatgcattgttcggtatgcacaacatgccgggcctgcctgccgggcacttgggttttcgcgaagggccgatgatggcttcgcaggacttgctcaacgtggtcatcgaaggcgtcggcggtcacggctcgatgccgcacctgacggtcgatccgctggtcgccgccgccagtgtggtgatggcattgcaaacggtggtcgcgcgcaacatcgatgcgcagcaggcggcggtggtcaccgtcggcgcgctgcaagcgggggaggcggccaacgttatcccgcaacaggcaatcctgcgcctgagcctgcgcgcgctgaatgccgatgtgcgcgagcagaccctcaatcgcgtgcgcaacatcatcgaaacccaggcgcaaagcttcggctgtacctcgacaatcgaacaccgcccggcctatccggtgctggtcaaccacgccgccgaaaccgagttcgcccgccaggtcggcgtcgagctggtgggcgccgatgccgtcgacggcaacacccccaaactgatgggcagcgaagacttcgcctggatgcttcagcgttgccccggcgcctacctgttcatcggcaacggcgtgtcgcggccgatggtgcacaacccggcctacgattttaacgacgacatcctgctgacgggcgccgcctactggggcgcactcaccgagagctggctcaagccggcctgacttcttcactttttgctgccgctgaaccccgggcccacgtgcgcccgggtgatcacccaacagctttatggagaatccgccatgcaggtttcgagcacaggtgtttcgcgtacccggcaagtggtcgctgcggttatcggcaacgcgctggaatggtatgacttcatcgtttacggctttctggcgagcatcatcgctcggcagttctttccctccgaagatggctacgcctcgctgttgatggcgctggcgaccttcggcgtcggtttcttcatgcgcccggtcggcggcatcctgctcggcatgtattccgaccgcaaaggccgcaaagcggcgatgcagctgatcatccgcctgatgaccgtgtcgatcgccctgatcgcgtttgcgccaagctacgccgccatcggcatgggcgcgccgctgctgatcgtcgttgcgcgcatgctgcaaggtttcgccaccggcggcgaatacgccagcgccacggcgtttctggtggagagcgcgccggctcatcgcaaaggtttatacggttcgtggcaactggtcgggcaatgcctggcggtgtttgccggcgcggccgtggtggcgctggttacccatgtgttttcccccgaggcgctggacacctggggctggcgtattccattcgtgatcggtctgttgatcggcccggtcggcttgtggattcgcaagcacatggaagaaccggaagagtttcttcaagcacgtaaaaaagccaaaggcgcagcgccgggcctgtggcaagtgatccgcgagcaccgccgcagcctgctggtgtcgatgggtttggccagcggcgcgacggtgtcgttttacgtggtgctggtgaacatgccgaccttcgcccacaccaacctcggcttgccgttggatcaggtgctgctggtgcagatgctcgcggtggcgttgatgacggtggtgattccgttctccggcgcactgtcggatcgtgttggccgccggccggtgttgatggcgttcacgttagcgtttttcgtgatgatttatccgctgtatgtgtgggtcgcggcggccccgtcgatcgagcgcttgctggtgatgcaactgctgctgtgcagtgcaattggcggtttcttcggcccggcgccgacggcactcgccgagcagtttccgattgaagtgcgctccaccggcgtgtctgtcgcctacaacgtggcggtgatggtgttcggcggcttcgcaccgctgatcgtcacctggctgagcaaggtcttgaacacgccggtggcgccgtccttctatgtgttgttcgcttgcctgctgaccttgctcggtacttactgtctgcaagaggcgccgcgcgcgaagaaatccgttgcgctgaatgtgggagtgaaaccgtgaaacctttagcgattgatccgattgtcgccctcgacgccgatgcgctgtcccgggcaatccatgcgcgccaggtgtcgtgccgtgaagtgatgcaggcctatctgacgcatatcgaacgcttcaacccacaggtcaatgcgctggtttcgctgcgtccggccgaggacgttttacgtgaggccgatgagtgcgaccggcaactcgatcgcggccagtccaaaggctggatgcacggcatgccgcaggcgatcaaggacttggcggccactgacggtctgcgcactactatgggttcgccgttgttcgccgagcaggtgccgcagcacgatgcgatcagcgtggcgcgcgtacgtgcctgcggcgcgatcatcatcggcaagagcaatgtgccggagttcggcctcggttcgcagacctacaaccgcgtgttcggcaccactaccaatgcctacgatgcaagccggattgccggtggcagcagcggcggcgccgcggtggcgctggccttgcgtctgctgccggtggccgatggcagcgacatgatgggctcgttgcgcaacccggcggcgttcaacaacgtcttcggttttcgcccgtcgcaaggccgtgtgccacacggaccgacgccggaagtgttcgttcagcaactggccaccgaagggcctatgggccgcagcgtcaccgatgtcgcacgattgctgtcgacgcaggccggctacgatccccgcgtgccactgtcgctgaaagatgagccgcgcaattttgctgaaggcctgccacaggatttcagcgacgtacgcattggctggctcggcgactacaacggctatctgccgatggacgacggggtgttgagtctgtgcgaatcggcgctggcggatttcactgcgttgggttgtcaggtcgaggcgtgccagccggatttctccatggcgcgtttatggcaaacctggctgacccaccggcattttctggtgcagggcagccttggcgcggcgtatgccgatccgcgcaaacgcgaaatgctcaaacctgaggcacagtgggaaatcgagggcggtttacgcctgagcgctgccgatgtctacaaagcctcggtcgaccgcagtgagtggtatcgcgcactgagcgaattgttccagcgttacgatttcctgctgttgccgaccgcgcaagtgttcccttttgatgcacaacagccatggccgcgcgtggtcggcgggcagaccatggacacctatcaccgctggatggaagtggtcatcgggccgacgttggcggggttgccgagcatcagcgtgccagtcggtttcaacccggcggggctgccgatgggcctgcaaatcatcggcccggcgcaggctgaccgggcggtgctgcaactggcgtatgcccacgaacaactgacccgttgggtcgaacgctgcccgccgccatgcctgcaatcagcctgagcggcccgcatcttgctgcaaaaagtgctcatccatctgcgcgcagggagatcgaacacatgggcagcaaagcggataccggcagcgtgcgttcggtggaacgggcgctggccattgtcgaattgctcggcgagcatcaggcgctggggctggaggaattgcactacctcaccagcctgcccaaagccacggtgtcgcggatgctggcgacgttgcaggaacagggctggatctatcgcggcctcagtgaccgccgttaccgcttgtgtgccaagcgcctgtttggcgatcgtcagcagcgcttcaagcgacatttggtggagagcgcggcgccgatgttgctggagctgagcgagcgcaccggactggtcgccgacttgtcgtgcttcgatggcgaacgggtcgaggtgatggagagcgcgattccgcaggtgttgcgcaagcgttatccgaacaactgccagatcgtcgggcatcacgccagtctgtttcattcggcgatggggcgggcgtgtcttggcgagttggaaagtgatgaggtcgagcggctcgccgagcgtgagcagttgagcgatgagggtttgtttcctgtgaccgagcaggccttgcatcaaggctttggtcagcgtaccgaaggctattgggaatacccggtgcgtttgccgtttctgattcgcgcggtggcactaccgattcgtgctgaaggcaagttggtgggcagcatggcgctgcactggccgatggatcaggcgccggtggagcgggtgttgagcctgcatttgaatagcctggcggcgacgattggcgatgtgcagcaggtattggcctgacagccaaaagatcgcagcctgcggcagctcctacatcaagcactgttcccctgtgagaacggcggtgtcacgattcgacagaaggcatatctattggctggcggtacgtttccccgtgcgagcccgcccccacattagaaatgtattccccctgtaggagctgccgcaggctgcgatcttttgctctggatgtttgcaataaccccatggccagttaaggttcgtgcaggtttatcgcccccacgagtcctcaatgttcaaccgctccctcattgcatccctgtccagcctgctgctggccaccctcgcgctgccggcgcaggccaattggtatctggacggcgagtcgtcgcggctgtcgttcgtcagtacgaaaaacgccagtatttccgaagtgcagcgttttctggtgctgcacggcaaggtcgatcccaatggtcgcgccgaagtcgaaatcgagctggactcgatcaacagcggcatcccgctgcgcgacgagcgcatgcgcaaggagctgttccagatcgagcaattccccgaagcgaccatcaccacgcagattgacttgcgcccgatcaacgatctggcccccggcgcgcaactggaattgcgcctgccactgacggtcaatttgcacggcaagcaacatgaatacccggccgaactcttggcaacgcgccttgatgatcgccgctttcaggtggtgacgctggagccgctggtgatcaacgccgaagatttcgatctggcaccggggctggaaagcctgcgcaaactcgccgatctgtcggccatcagcctgtcggtgccggtgggtgcggtgctgatcttcacggcgcgctgacatgcgcggcgcagtgttcccatggcgtgacggtaatcggttcgagctgttgatcgacggcccgcaattcttcccgcgcatgcttgagcagattgctggcgctcaggagcagatcgagctcgagctgtatctggtcgaggccggcgcctgtgccgaaaccatcgtccaggcgctggtgctggcggcggagcgtggcgtgcgtgtgcgttgtctgttcgatgattacggcagcctcgccttcaccctcaatttgcgtcagcgcctgactcatgccggggtggaactgcgtttctataatcggcttaactggcggcgctgggtcggcaacttctatcgcgatcaccgcaaattgctgctggtcgatcaatgtctggcggtggtcggtggcaccggtgtcaccgatgagttctggacgccgggccatgacagcagcgaatggcacgaagtgatggtcgagatcagcgggccgttggtgatcgactggcaattactgtttgatcgccaatggatcgctaaccgctaccgccgcgcctggcgtccggccgcacatttcggtctgccacggttaccgcgcgtgccggacaagggcgagggcatgggccgcgtggcgtatgccgacgcccgccagcaccgtgacattctgcagtcgctgttccgcgccttgaacagtgggcaaaaacgcatctggatggccacgccgtattttctgccgacgtggaaaatccgccgctccctgcgcaaggctgcggcgcgcggtgtcgacgtgcggctgctgctgaccgggccgcgcaccgatcacccgtcggtgcgctacgccgggcatcgttactacccgcgcctgctcaaggccggggtgcagatattcgaatatcagccgtgctttttgcatttgaaaatggtgctggtggacgattgggtgagcatcggttcgtgcaacttcgaccactggaacctgcgcttcaatctggaggcgaatctggaggcgctggatccggcgttgacggcagcggtagaggcgagttttgtgaaggacttcgggctgagtcagcaggtaagtctggaagagtggcagcgccggccgttgtggcggcgggtcaagcagcgggtgtggggctgggtggatcgggtggtggtcaatatcctcgaccgccgcggttaaattaacgctgcaaaaccaatgtaggagtgagcctgctcgcgatagcggtgtgtcagtcagcattgaattagctgaatgaccgctatcgcgagcaggctcactcctacaaggggactgcgttgtcggttacagcaactcgaagctctgctgcgtcacgtcctgcgaatccaggccgatctgcacgttgaacttgcccggctctgccgcgtatttgagctgggcgttgtagaacttcaggtcatcctcggtgatggtgaagtgcacgactttctgttcgccggccttgagcatgattttctggaagttcttcagttctttcaccgggcggatcatcgaaccggtgacgtcctgaatgtacaactgcaccacggtttcgccgtcacgcttgccggtatttttcagcatgacgctggcgtcaagcttgccggtggcgttcagggtggtcgacgacagcgccatgtcgctcagggtgaactgggtgtagctcaggccataaccgaacgggaacaggggacctgtggtgtcatcgaaatactgcgaggtgtagttgcccggtttgcccggcgtgaatggccggccaatgctcaggtggttgtagtaggtcgggatctggcccacggagcgcgggaaggtcaccggcagtttgcccgacgggttgtagtcgccgaacagcacgtcagcgatagcgttgccgccctcggtgccgctgaaccaggtttccagaattgcgtcagccgactggttctcttcgaggatggtcagcggacggccgttcatcagcaccagcaccaacggtttgccggtggctttcaacgcacggatcagctcgcgctggttttccgggatgttcagatcggtgcggctggaggattcgtgggacatgccacgggattcgcccacggcggcgacgatcacgtcagcgtccttggcggcttttaccgcttcgtcgatcagcaccttggccgggcgcgggtcatcgaccacttccggcgcatcgaagttgaggaagttcaggtagtcgagcaccttcttgtcgctggtgatgttggcgccacgggcgtagatcaggttcgacttgttgccgatcaccgagctcatgccatcgaacagtgtcaccgattgcgccggcttacccgctgcggcccagctgcccatcatgtcgatcggtgctttggccaatgggccgaccagcatgacttttgcgtctttcttcagcggcagggtttcgttctggttcttcagcaataccaggctgcgtcgcgccacttcacgggcctcggcgcggtgcagacggctctcggcgtaggtgtcgaccggatcatcttcagccttgccgatgcgcaggtacggatccttgaacaggcccatgtcgtacttggcggcgagcacttcacgcaccgcgttgtcgatgtccttctgttcgatctcgccggccttgagcagccccggcagctctttgccgtagagggtgtcgttcatgctcatgtcgataccggccttgatcgccagtttcgctgcttcacgaccgtcgcgggcgacgccgtgtttgatcagttcgaagatcgcgccgtggtcgctgaccgccaggcccttgaagccccagtcacgacgcaacaggtcgttcatcagccaggtgttggccgtggccggaatgccgttgatcgagttcaacgcgaccatcacaccaccggcacccgcatcaatcgcggcgcggtacggtggcaggtaatcctggtacatcttcaccgggctcatgtcgacggtgttgtagtcgcgaccgccttcaaccgcgccatacagggcgaagtgcttgacgctggccatgatgctgtcggcggcgctcggggtggcgccctgataggcacgaaccatcacgccggcgatgcgcgaggtcaggtaggtgtcttcaccgaaaccttcggagctgcggccccagcgtgggtcgcgggagatgtcgaccatcggcgcgaaggtgatgtcgaggctgtcggcggcggcttctttcgcggcaacacggccggactggccgatggcatccatgtcccagctcgaagcgagggccagcggaatcgggaaaatcgtccggtgaccgtggatcacgtcgtaggcaaaaaacatcgggatcttcaggcggctgcgcatggcagcgtcctgcatcggacggttttccgggcgggttatcgagttgaaggtgccgccgatgttgccggccgcgatctctttgcggatcagctcgcgaggcatttccgggccgatgctgatcaggcgcaactggccgatcttctcatcgagggtcatttggttcatcaggttgctgatgaacgcgtccttgttttccaggggtaccggggtcgtggcggccaatacttgatgactggccaggctgacgaacagacccagcaaacacagcttcttcatgaatatttttctcaagggcacaaacggcaatgcaatgccggccagccaaaatttagggagcgactattgttgttcgggtacaggctcaaaaaagcagagccagaaacggcagccgacacggcggcagcgtgatcgcgcagggcactttttagcccattggcgcgtcgtaatccagcagcgcggccgattatgccccaagagccggcggagaatgtttcgcgctcggtttttataatgaaatgtgccaaggagcatcactgcgatgaatgtaagcccaaccaatcgctcgcgtttgcaggtcgccacactgctggtgctggccacgctgttgaccgcgtgcggcatcaacaatatcccgaccctcgacgaacaggccaaagccgcatggggccaggtgcagaaccagtatcagcgccgcgccgatctgatccccaacctggtggaaacggtgaagggttacgccgctcatgagcaggaaaccttgaccgcggtgatcgaggctcgggcgaaagctacgtcgatccaggtcgacgccagcaccctcgacaatcccgagaaactcaaacagttccaacaggcgcaggatcaactgaccggcgcgttgagccgtttgatggtggtctccgagcgttacccggacctgaaggccaaccagaacttcctcgccctgcaatcgcaactcgaaggcaccgagaaccgcattgccgtggcgcgccgcgatttcattctggcggtgcagaaatacaacaccgaaatccgcacctttcccggtcgtctctggcacagcgtgatgtacagcgacctgccgatccgcgaaaccttcgaagccaccacgccggatgccgataaggcacctcaggtcaaattctgaaaacacacctgtgtaggagctgccgcaggctgcgatcttttgacgttggtttgtaaaaacgagatcaaaagatcgcagcctgcggcagctcctacagcggacggtgggggtaatagatgcgtgtgttgaagatggggctggtgttgctgttgtgggtattgaccttcagcgcccgggccgagttgacgttcccggcgctgagcgggcgggtggtggacgaagcgcagatgctcgagccgtcggtgcgcgcgcaactgggccagcagttgcaggcccacgagcaggcgaccggcgagcaattggtcgtggtcaccgtgccggatctgcaaggcaccaccattgaagattatggcgtccagctgggccggcactggggcatcggccagaaggacaagaacaacggcgcgctgctgatcgtcgcccgtgacgagcgcaagctgcgcattgaagtcggttatggtctggaggaccggctcaccgatgcgcagagttcggtgatcatccatcaagtcatcacccccgcgttcaagaccggcaacttcagcaaaggcatcagcgacggcgtcgcggcgatgctggtagtgctcggcggcaatccgctggatgagccgtcgacggtgtatgaatcgagcggtgatccgtccgatgatttcgtctcgcggcatccggcattgttcgtgtttttagtgatgttgttcatcctgacggtgtttgtctgccagatgctcggtatcctgcctgccggccgtggcggctccggaggcgggggcggctttggcggtggtggcggttttggtggcggcggtggtggaggcgggggcttcagcggcggcgggggcagtttcggcggcggtggttcatccggcggctggtgacattaaaagaataatgagcaggcacttttcaacatggcattactgactgaacacgaacaacgcaaagtcgccgaagcgatcgcccgggtcgagcgcgacaccgacgccgaactggtgacggtactcgccgcccgcgctgatgactacgcttacatcccgctgttgtgggcgagccttttcgcgctggtggtgcccggcgtcgtgcactacctgaccgggtggttgaccatgcacagcttgctgctggtgcagtggggcgcgtttatcgtgctgtgcctgctgtttcgtttgccgaaaatcactacccatctaatcccgcgtcgcgtgcggcattggcgcgcgtcgaacctggcacgccggcagttcctcgagcagaacctgcatcacacggtgggcagtaccggcatgctgatttttgtctgtgaggcggagcggtatgtggagattctggtggatgaggggatttccaaacggctggataacaagagttgggatgcgattgtggcggcgtttactgagcaggtgcggcaggggcgcacgctggaagggtttgtgacgtgtatcgaggcgtgtggggaattgctgaaggtgcatgtgccggtgacgcaggttcggaatgagttgccgaatcggttgattgtgctggggtaagacaaaccctcaccccagccctctcccggagggagagggggccgaccgaggtgtcttgcgctcgacatcgacctgaaagaccgagtcgattatggatcaacagatgatcgtttgatttgatgcttttaatacccgagttcgactcggtatttcaggtcggcgtaactcgtgaaaacacctcgatcagtcccctctacctctgggagagggctagggtgagggtgcttctgacaaccgttgggtaaataagagcgtgtccccaacccccatcccccctaaaatacccgccattcccgatttcgcccgtccgaggccgctttttcatgtccgttaccgcccctgccacccagcctgcgcccgatcaccacgcccagttcatcgagctgctgcaaaccagcctcgaacagaacggcttcatcaaactggtgctggccaagtacgtcggtgaagaagcggatctgcagcgggtcaacatcaaagcggtgacggtcaaggcgcagccgaatctgtcctttgtctatcgttacaagactcgcgatatcaccaagaatctgccgttgagcgaaggcgtggcgacgattgccgcgctgctgccgacctcgttcaaaaatgcgcatttactcgcggtcactgacgaagctcagctggaatacagcaaaaagggcaaatcttcgctgttcaagagcaaacctcagcaattgcgcgaagcaccgtccgccgagcataaccgtgagaaaaaccgttttcttgaactgagccgaccattcctcagggacctgggcgtgaccaacgcgcagcacgagctgatccccgcgatgtcgcgcaagtggaagcagatcaacaagttcatcgaagtgttcagtcatgcgctgacctcgtcgccgctggccctggacaaaccggtgcgcgtggcggatttcggttcgggcaagggttacctgacgtttgcgattcacgattacctgcgcaataccttgcaggccgaaggtgaagtcaccggcgtcgagttgcgtgaggaaatggtcaacctgtgcaacgcagcggcagcaaagctcgagcatccggggctggtgttcaagtgcggtgacgtgcgcagcgtggcgccgagcgaactggacgtgatgatcgccctgcatgcctgcgacatcgccaccgactacgcgatccacaccggtattcgctcgggtgcgtcgatcatcatgtgctcgccgtgctgccacaagcagatccgcctgcagatccagagcccggcgctgctcaaaccgatgctgcaatacggtttgcacttgggccagcaagcggaaatggtcaccgacagcttgcgtgcgctgtttctggaagcctgcggttacgaaaccaaggttttcgagttcatttcgctggaccacaccaacaagaacaagatgattctggcggtgaaacgcgccgagccggtggatccggctcagctgttggtgaagattcaggagttgaaagacttctacaacatcagcgagcactgcctggaaaccctcctgcgcgctgacggctacctggcctgacacaaaaacctgtgggagcgagcttgctcgcgaaggggccataacagccaacatcatcgttgactgtcagtccgccttcgcgagcaagctcgctcccacatttgatttcaccgcagtcttgcggccgagcatgaccgttgcaatcacgccacacgcaaacacccaggtaatcggctcgacatgctcaccaaagaacaacgccgaaaacgcgatggtgaagaagatctgcaacagctgcacctgactgacccgggaaatcccgcccatggccaacccggcgtaccaggcaaagaaaccaagaaactgcgagaacagcgccacatatccaaacgcccaccaggtcttggccgacaccgcgccgtgatgctgcagcgcaagatacagcaccggcccgatcaacagtggtgtcgacagcaccagcgcccagcagattacctgccagccccccatctccttggccaaccggccaccttcggcgtaacccagcccaccgaccgcaatcgcgccgagcatcagcagatcgcccgcctgaatactgccggccccggtgtacagcgcataaccgagcaccaacgcactgcccaacgccgcgcaggcccagaaggctttcgacggccgctcatgggacaaccacgcggcgtatagcgccacgcacagcggttgcaagccgttgaccagcgccccgtgggacgccggcaaggtttgcatggcccacgccgacaacaccgggaaaccgagaatcactccggcgatcaccaggctcaggcctttgacctgccgccacgtcggccatttctcgcgacgccacagcaacagcaacgccgccgggatcgctgcaaacaatgcgcgacccaaaccgttgagcaatggatgcagttcctgcaccacgatgcgggtgaagggcagggtgaggctgaaaatcaccacgccgagcaggccgagggccatgccggtgttttcgcgcgaggacatgatggtggaccagaattgaaggtggcagggaatgacctttataaagccataaaccgggtggttcgggctgttacagctgggcacagacttaggcgtacagtttgccggcgtcatcgcgagcaggctcactcctacatttgaaatgcgttccccctgtaggagtgagcctgctcgcgatggcgtcaactcggtagtagccggttgttacccgagccgctggataaggtctaccttgaatactcccaagcattcccccagaggagtcctccccatggccgcgaaaaagatcctgatgctggtcggcgattacgtcgaagattacgaagtgatggtgccgttccaggccctgcaaatggttggtcacaccgtccatgccgtgtgcccggacaaggccgccggccagaccgtgcgcaccgcgatccatgacttcgaaggcgaccagacttacagcgaaaagcccggtcacctgttcgccctcaactttgacttcgccaaggtcaatgaagccgattacgacgcgctgctgatccccggcggccgtgccccggagtacctgcgcctcaacgaaaaagtcctcgacttggtgcgttccttcgacaaggccggcaaaccgattgcggcggtctgccacggcgcgcaactgttggcggccgcgggcgttctggaaggtcgcgaatgcagcgcctatccggcctgcgcgccggaagtgcgactggcgggtggtacgtacatcgacattccagtgacggacggccacgttcaaggcaatctggccactgccccggcatggccggcgcatccgcactggctggccgggttcctcggtttgctcggcaccaaaatcaccctgtaacgaggaatcgccgatgtgcgagctctacgtcaaggctgacccgattctctacgaatcacgttcgcgctcgctgcgcatctgcggcgtggtgacgacgctacgcctggaaaatcagttctgggacatcctcagcgaaatcgccgaagtcgacggcatgaccaccaatcaattgatcgccaagctgtatgaagaggtgatggattatcgcggcgaggtggtgaattttgcctcgttcttgcgggtgagttgtatgcgctatctgagtcagcggcgggtgagtgcgccggagttatcggtggtgcgggcggtggtgaaatagccggcaccgagttgcctcattcgcgagcaggctcgctcccactttcgaccgcgttctccaactggaatgcgctcaaaggtgggagcgagcttgctcgcgaaggggccggtacaggcgacagaaatccaggactggtctttactctgaagcgcgaaatctctcaattgccaaggagaaacgagcatgtccggatggtacgaaatcagtaaaagcagcaacggccagttcaggttcgtgttgaaagcagcgaatgccgaaaccattttgaccagcgagctgtacaccactcgcgcagcggccgacggcggcatcgctgcggtgcaaaccaatagcccgctggatgagcgctacgagaagaaatcgacgaaggacggccatccgtacttcaatctgaaagcggccaatcatcagatcatcggcagcagcgaggcgtattcctcggagtcggcgtgcgacaagggcattgccagtgtgaagacgaacggtccgagcaaagtgatcaaggacaagaccttgcctgtcctctgaactcaccacatccccctgtaggagtgagcctgctcgcgatagcggtgggccagtcgacacatgctcaactgacccaccgctatcgcgagcaggctcactcctacagtggtttttgcggtgccagtgagatcagcgcagggtcttcaggatcgtctgcaattgagtctggcctgcttcactcagcgggaataccggcaagcgtggatcgccaacctccagcccggtctgccgcaagccagccttgatcgtcgccggcaagccacccttgagaatgaaatccagcagcggcaactggcgatagaacagatcccgcgcccgatccagatcgccggccatggccgcgtcataaagatccagattcaactgcgggatcaggttcggcgccgccgtgcaccagcctttcgccccggcggcaaacgcctccagcgccagcggattgcagccgttgtagaacggcacctgacattcgccgagcaattgcagcttgtgcatgcgttgaatatcgccagtgctctccttgaccatggtcacgttttccacggcgttgacgatgcgcagaatcaaatccaccgacatgtcggtgccgctggtggccgggttgttgtagagcatgatcggcacgccgatgctctcgccgatggcgcggtagtgggcgaggatttccgcttcggtgagtttccagtacgaagccggcagcaccatcaccacatcggcgccatgggcttcggcgaaacgcgcgcggcgtacggctttggcggtggtcaggtcggacacgctgacgatggtcggcacacgtttggccacatgcttgatactgaattcggcgacctgatcccactccgcgtcgctcaggtaagcgccttcgccggtgctgcccaatggcgcgatggcgtggacgccgctgtcgatcaggcgatcgatcgattgacccaaggcgggcagatccagtccttcgccgttagtggtgaacggggtgatggtgtagccgatgatgccgtgaatattggacatgaggttgtctccgtaatgggtgttcagttcaggcaatcggcgtgttggcgcaggttctgccgggcgtagtaattgaaggcagcggcgtggcgtttcggcttggcaatccagtcatgagcctcgcggcccagctcggggatgatcggtttgatcgtgcccgccgccatcgccagcagttgcaacttcgccgcacgttcgatcagttgggcgatgacacacgcctcttcgatcgtcgtgccggtcgacaattgaccgtgatgcgaaagcacaatcgcgcgtttgtcgcccaacgcgccggcaatcagttcgccttcttcgttacccaccggcacccccggccagccttcgagaaacgcgcagtcgtcgtacagcgggcacaagtccatgtgggaaatctgcagcggcacttcgagcatcgacagcgccgccacgtgcgtcggatgagtgtggatgatgcagttcacatccggccgggcgcggtacacccagctgtggaaacggttggccgggttggccatgccgtgaccttcgagcacttcgagatcctcgttgaccagcagcaggttgctcgcagtgatttcgtcgaaacccaggcccaattgctgagtgtaataggtgccgggctgcgggccgcgagcggtgatttgcccggccagaccggagtcgtgaccgttctcgaacagaatccggcaggtcagagccagcttttgccggtctgtccacgtattatccgccaggcttttttgcatctggataagcgcttgcttgaccagttggtctttgggtagtgctaatgtcttggccatgtctgtgtcctttgggtgattgcaaatgacactaaagaggctatatgacacaaagtgtcattggcaagcacgaattgtcgcttccttgctggaataatcgccgcgcatgtctatccgtttgaaattgttgagaaaaaaacttggcgtaacccttgaggcattggccgaaaaatccggcatgaccaagagttatctgtcgaaagtcgagcgcgggctgaacaccccgtcgattgctgctgcgttgaaactggcgaaggcgctgaacgttaaggtcgaggaattgttttccgaagacaacgtcagcctcgacagctatagcctggtgcgcagccatgagcgccagtcactggcggcgaatgatcagagcccagggtatgcggtgctggcccatcaggtcagcgagcgtaacttgctgccgttcatcatttacccgccgagcgagttcagcgacaaaacgttcaaagaacacttgggcgaggagtttctgttcgtccacgaagggcaggtggaggtggatttcatgaacgagaaggtgctgctgcagcgcggcgatgcgctgcacttcaatgcgcagaaaccgcaccggatcaggtctgtgggggaggtgcaagcgcagttgctggtggtggtgcacagcgccgaagaatgagttgattgggctaaagttatcgcgagcaggctcactcctacagttgaaatgcgatcccccgtaggagtgagcctgctcgcgatagcgtcggaagcctcaccatcaaacctcgaccggcaccgataacttcggactgccaagcgcatgcgtcttcgcatcaaaaaaccgcaacgcaacccccgtcccctcaaacacctgcgcgtaatgccgcttctgatgctgaacaaacgccgcactgcgcgggtaaatcgagatcgccaccgtcgcaggtttcgccaatcgcagcgcccgcacgatgtgcgcatcctgctcgcccaacgcatggccaaagatgcacagactgccgccatgctcgagcaattgctcataacagaacgacagataatccgaactgcgaatggtcttgagcttgtccgcactcggcccttcggtgacgaacagcggcacgtcatccagcgtcttgatcgtattgttgatcgcgaagctaccaagcaacgtgccttcggttgaggtcagtttgcgcacggtgccgtcctgattgcgcaccagatgcagaccaccgtgcagataaagcaaacgcggtttgtcggtggcagtttcgctcagatcaaaactcgcattggcgccgttgaacagatcgtcgatggccccgctttggtgttgcagcgcccagtagttgagcaagtcgtaattggtggtgaacaccgtgcggtagcgcgccagttcttcattcagtgtcgccagcgtcgaggctttcaccagccgccacggaatgtgcaccgcgtgcacggtgttgatcagcgcttccttgatcgcgtagtagcgattgcgcggcgccgccgaactgacggccagggccttgttgacccgactggtggttttcagagcgccgagcacctgctcgaagctgcgcgtctgcatggcgtcgaacaccgccagttccgacgggctgagcggtttttcttccacggtgcgggcgttttcgaacagcgagtcgtagccgaagtcgtcccacaccgcacggctggcaccattgcccaccaacaagccgttgaagtcggtcgcggcgcgcagggtgttccagtcttcaaggctggcgtcgacatccagaaaatcggtcattgcgtaggcggtctcaaaacaaaggggctgatgggcggcgactttatcacgagcgggcattgagccagatcaacatcgctcgtgaccgatcggtcgatgctgtgtctatccgccgaaccggagcagtcgattcggccccagtcaggagacgcgcgcatgaccagtacctttttcattccggcggtaaacatcatgggcaatggttgcctcgacgaagccatggttgcgatccgcaactatggttttcgcaaggcgctgatcgtcaccgacaccgggttggccaaggccggcgtggcaaccatggtcgccgagaaactggcgatgcaggacatcgattcggtgatcttcgacggcgccaaaccgaatccaagcatcgccaacgtcgagtccggcctgggtttgctcaaggaaagccgctgcgacttcgtcgtgtcccttggcggcggttcaccccacgactgcgccaaaggcattgccctgtgtgcgaccaatggcggacagattggcgattacgaaggcgttgatcaatcgagcaaaccgcaactgccgctgatcgccatcaacaccaccgccggcaccgccagcgagatgacccgtttctgcatcatcaccgacgaatcgcgccacgtgaaaatggccatcgtcgaccgcaacgtcacgccactgctgtcggtcaacgacccggagctgatgctcgccatgcctgaagccctgaccgccgccacgggcatggatgcgctgactcacgccatcgaagcctacgtctcgaccgccgccaatccgatcaccgacgcctgcgcgctcaaggccatgaccctgatcagcaacaacctgcgtctggccgtgcgcgacggcagcgaccgcgccgcacgggagaacatggcgtacgcacaatttctcgcaggcatggcgttcaacaatgcctccctcggttatgtgcatgcgatggcgcatcagttgggcggtttctatgacttgccccatggcgtctgtaacgccgtgctgctgccccatgtgcagacgttcaatgcgctggtctgtgccgagcggctgaacgacgttgcccacgcgatgggcgccgacattcggggttttagcgccgaagagggcgcgcaagcggccatcagcgcgatccgctgtctggccaaagacgttgagattcccggtggcttacgtgaactcggcgccaagctcagcgacatcccgttactcgccagcaatgccctgaaggacgcctgcggtctgaccaatcctcgggcggcggatcagcgccagatcgaggaaatcttccgcaacgccttctaacgcttggcgccgatcggcgccatccgtatacagaacatcgcgccgacggccagcaacgtgcacagcagcgacaggggccaagcgtgtgggctggcgatcagactggccagcgcgccgatgatcgccgccatcaattgatgaatgaacccgctcagcgccatcgcatacgccccggcaatcggcgcgccatcgttggcgcgcgacaggctgatcgggtagttcaatgattggccgaacaccgccacgcaatacggcaaccaaaacagtaacgcgatggaactggccgccagactgcccagcaacatcacgctgctacccgccaataccaaccctgcgccgacggtcatcaaccacgcttggccggtgcgcagcacaaagtgattgaccgccagcgccccgagaaaataggccgcgctgattggccagccgagcagtccgtaatccaccgacgaccacgcgaacgggccctgcaagatcaggggcgccgccgtgttgaaagcgatgatcacaccgtagcccaagccaccggccagcgccggcagaagaaacgcccggtgcaacagaatctgccgataagccgaccacgatgaggcgctggccggttcatcagccatcggggggaaagcgactcgcgacaccatcagcgccatcaacaggctcgttgcgccgagccagtaaaaaatcgcttgccagcccgccgtcgcctcgatcagcgagcccgcgtattggccgatgcccaaggccaccacgaacgaaatcgaaacccacgacaacgccttggccagcagatcgccgcgaaagctgtcacggatcagcacccgcgccatcaccgaaatgccgctggcaccgacgccttgcatcagacgcagcagcaaaaacgcttcaagcgtcgaacctcgcggcaacgccagattggccaagccgtaaatgaccagcgctgccaacaacaccggtttgcgtccgatgcgctgggccagactgccccagagcaacatcggcagcgccatgccgatcaggtacagcgacaacccccacgacacctgcgcaggttctgcccgcagataaagggcgatctgcggcaatgccggcaaatagatactcatgcccaactgagcgagaaaaaccgtgctgcaggtgatcaggagggtgatgctggcgttcatgactcgtccctgttttcagtcgtcgagatcgcaacggtgggtacgcaacagaccggtgatcacttcacagaagcgccggatcagcgccggctgcatgtccgcgcgcagcgtaatacggatggcggccttgccttgtgcgaccaccgggaaaaataccgcgctggtgaaaaatccctgttcggccaattcactggcaatacgattggccacgttagcctgtgcgcatgtgatcaaccgaatggccatgttgctgtggcattgatcggtgcagatcaggctgtcaaagaggcggatattagcctgaagattgctttgcagcgtggcgaactcggcgctgcgatgcaggcggatcgacgctctgccggcaccgatcgccgcgcagttgagactttgcgaccaattgcttggcccgccgtagcgctgaatcagcgtcttctgtcgctcgttgcccaacatcaccaacccgccgctggcgccaaacgacttggccagtgacgcgacgatcacgcagtcctcctccagcgccgctacccttggtcgaacgaggcccgcgccctgctgaccgacagcggacaacgcatgggagtcatcaagataaagaaacagcccatagcgatcctttaaatacaacaggccttccatgttggtgacgccgcccatgctgtacgcgccatcggcgacgtaagccacgcggccgtgttgctggcaggcgctctcgagaaaatccatgtcgttgtgcggcgcagtcaccacgcgggtttcgtcggcgcacgcggccttcagatgattcatcgaataatgcgcgtgacggtcaaacaccatcactggcggctggccttcagtgaagatgccgctcgccagcaagggcaggatcccggcgctggccgcgctgcaagacaaggtgctcaggcagaccgcatcgaacagttgcgacaattcgttctcgtattgctcgagaatcgccagtttgcagcggttcttcgagttggcgacgcgcaggctgccggtttcgcgcagggcggtgatggcgccttcgagcagggctgggtgatgatcgagcccaaggtatgaggtcgtacagaagtgatggaattcacgtccgtactgatcaagcaggtggttgggactctgcactgcaacattgagaccggtgaccttgctctgttcggcgatctcccaatcgtagtcggccagggcgatgattttgcggaaatttgaatacagattgggcgtatgcaacggaagattcacaggcgacattccttgagcgtagcgatccatggggtgttgcaatttgtgtgtgttgccagactttacagaacgaaaaatccggaaaaaatcagctgtttctgcgaatcctgaaaggcgacagagttttgtttgtagggcgaaaccacaaaatctatcgagcaatcacctgtctgacgtgggcgaaaatcgggctatcctgccgatactgaccaaccccagtcattgagccttccatgttgcaaaaaagcctgatccgccgcctcgacctgatcaccctgcaactgtttgtcgccgtgcacgaagagggcacgctgacccgtgccgcctcgcgcgaagccatcgccgtgtcggcggcgagcaaacggctgatggagttggaagaggcgctcgggatcagtttgttcgtgcgccaggccaagggcatgacgctgaccccggccggggaaacactgctgcaccatgcgcggcaaatgctgttcaacgtcgagaaaatgggccttgagctcggcgaacacagtcacggtgtgcgcggttacgtgcgcatgctggcgaacctctcggcgatcattcagtttcttcccgaagacctgcgcgacttctccgcgcagcatccgcaggtcaagaccgaccttgaggaacggcccagcgccggggtgattcagggggtactcgatggcgtggcggatctcggtatctgttccaacgacagcgacaccaaaggtctgcacagcgtgttgtaccgccaggacaaactggtggtggtgatgctgccggagcatccgttggccgcgcgtgaattcgttgccttcagcgaaactctggacagcgattacgtcggtttgcacgcggccagttcgatcaacatgcgcacccacgcggccgcgcgccaggccggtaaagtcctgcgaattcgtattcatgtgccggggttcgatgcggtgtgccggatggttcaggccaacatgggcattggcattttgccgcagcgcgcctatgaactgtttggtcaggcgctggggttgcacgcggtgccgttgacggatgagtggtcggatcgcgcgttaattgtggtggtacgggatgaggcgcggttgtcgccggtgagtcggttgttgtttgagcatttgcgcgggcagggctgataaatttccgctgaatgagctggcctcttcgcgagcaggctcgctcccacagtggatgggggctgaacacagaatctgcagccgccaccaatccctgtgggagcgagcctgctctggaagactgattggaattcacccctgagcgttcgcatttcgcgaacgccctttgccgagagacggctggattgcccagtcatcgttcctctagccttggccgcatattccaagaacaagaggtaccccgcgatgactgcccccttgagtgcgatcaaagtgatcgagatcggcaccttgatcgccgcgccgtttgccgcgcgcatgctcgccgagttcggcgccgaggtgatcaagatcgaagccatgggtcagggcgacccgctgcgcaaatggcgcaagctgcacgaaggcacgtcgctgtggtggtacctgcaatcacgcaacaagaaatccctggcgctcaacctgaaatccgcggaaggcatcgagctggtcaagcaactggccagcgatgccgacgtcatcatcgaaaacctgcgccccggcgcgctggagaaactgggccttggctgggacgtgctccacgcgctgaatcccaatctcaccctcgtgcgcatttccggttatggccagaccggcccgtaccgcgaccgccccggctttggcgcgattggcgaagcgatgggcggcattcgctacaccactggcacccccggttcgcccccggcgcgggtcggtgtcagcctcggcgattcgctggcctcgctgcacgcggtgatcggcgcgctgatctcgctgctacgggtcaagaccgggcagggcggcgggcagatcgtcgacgtgtcgctggccgaaagcgtgttcaacgtcatggaaagcctggtgccggaatacgacatgctcggccatgtccgtgagcgcagcggcggcgctttgccgggcatcgcaccgtccaatacttacctcacggctgatggcgcttacgtggtgatcgccggcaacagcgacccgatctacaaacgtctgatgcacaccattggccgtgatgacctggctgatgccgaagaatttgcccataacgatggtcgcgccgccaaaagcggtgtgctcgacgccgccatcacccactggaccagcagcctgccgatcgacgccgtcctcgcggcgctcgaaggcgcagaagtgcccgcaggccggatctattcggtggccgacatcgttgccgatccgcactatcaggcgcgggacatgttgctcaacgcccaactgcccggcggcgcaaccgtgaagatgcccggcatcgtcccgaaactctcggagacccccggcggcgtgaactggtcggggccgacactcggccagcacaccgacggcattctcaccggcctcggcctgactgaactcgacatcgaacgcctgaaaagccaaggggtggtgcaatgatcacggactattcgcaaaccttgatcgtccaggaagtctcgccgcgcgacggcttgcagatcgaaccgacgtgggtggaaaccgtcgacaaaatcgcgctgatcgatcaactgtcgctggccggtttcagccgtatcgaggcgggttcgtttgtgtcgccgaaagccattccggcactgcgtgatggcgaacaggtgttcaaggggattcagcgtcaaccgcaggtgatttacgtcgcgctgatccccaatctcaaaggcgcgcagcgcgcactggaggccggtgccgatgagctgaatctggtgatgtccgccagccagacgcacaacatggccaatatgcgcatgcgctgtgaagactcgttggcggcgtttgcagagattgtcgcgttcgccagcggctccggcgtgcgcctcaatggcagtatcgccacgacgttcggttgcccgttcgaaggtcagattgacgaggatcgcgtgctgcaaatcctcgacgcttatcaggagctcggcattcagggcatcaccctcgccgacaccaccggcatggccaatccgcgacaggtcgatcggttggtgcggcgggtgttgcagcgggtttcgccggcggatctgaccctgcattttcacaacacccgcggtctgggcttgtgcaatgtgctggcggcttatgaggcgggggcgcggcgtttcgatgcggcgcttggtggcctcggtggctgcccgtttgcgccgggggcgtcgggcaatatctgcacggaagacctggtgaatctgtgcgatgagatcggcatccacaccggcattgatttgccgctgttgttgcaactctcgcgaggtctgccggctttgcttggccacgaagtccccggccaattggccaaggccgggcgcaactgcgacctgcacccgatccccacctgacaacaccaatccccctgtaggagtgagcctgctcgcgatagcggtgtgtcaggcaacatttgcggtgattgatacaccgctatcgcgagcaggctcactcctacagttaaaaaccgaaccagacaacaacaacaatcggacgcccaccggcagtccgcctggagaaaagctatgagcctcaatgtaatggaggcgggcgcaagctcgtccgtcgatcacgatgccgaaaaagccctggtcagcaaagtcgcctggcgcctgatgccgctgatcatggtctgttacctgttcgcctttttcgatcgcatcaacatcagcttcgccaagttccagctgcaagccgacctgagcctgagcgataccgcttacggtctcggcgccgggctgttcgtggtcggttatgtgctgttcgaggtgcccagcaacatgatgctgtacaaggtcggcgcgcgccgctggatcgcccgaatcatgatgtcctggggcgtggcgacggcactgatggtcttcgtgaccagtgaatggcagttctacgcgctgcgctttgtgatcggtgcgatggaagccggttttgccccgggcgtgctgtattacctgacgctgtggtttccgcagcacttccgtggccgcatcacctcgatgctgtttctcgcctcagcgtttgccgggctggtcggcgcgccgttctccggcctggtactggaacacctcgacggcgtgctgcaaatgcgcggctggcactggttgtttctgctcggcggcgtgccgtgcatcggtctcggttttctggtgctgatgctgcttaaggatcgcatcgaggatgcgcactggctgacggctgacgagaagaaactgctgtccagccgcatcgcccagcatgaaccgcacaagagcggcggctcgctgctcgcggcgttgaagattcccggtttcctgaccttgggcctgatctacttcctgatccaggtggcgtcctacggtttgaatttctgggcgccgcaattgatccgcagcgccggcaccgagagcccggtgatgatcggcctgctgacggccattccgtacatttgcggggcgatcagcatggtggtgatcgggcgcttgtcggacgcgaccggtgaacggcgcaagtttgtcgccgggctggtcattgtcggggcgatcggttttttcagcgccgggatatttgccagccacaccacgtttctgatcgtcgccctcggcttgctgggcgccgggatcattgcctcgattccaagcttctggaccttgccaccgaagttgcttgccggtgctggcgctggcgcggcgggcgggattgcggtgatcaacacgctggggcagttcggcgggatcgtcagcccggtgatggtcgggcggatcaaggacctgaccggcagcaccacgccggcgctttacgtgattggcgtggcggcactgattgcggcggcgttgctgttgtggggactgccgcagaaactgcgcacgctcgacaggttctgagatcggcggcgcctgcaatgacgccttcgcgagcaagctcgctcccacagttgatcgcattcctccagttggaattcggcacctgtgggagcgagcctgctcgcgaagactgacttccagacgctgaaaatcatcgattaaaacgatcatccagcagccattgcattcctctcaaacaccccgccaaactgaatcaacaccactcccgcaatcaacaacaccgcacccaacacccgcgacaccgtcagctgtttctccaccagtccaaacaagcccaagtgatccagcgccatcgaggcaatcacttgcccggccaacgccagcgcaacaaaccccgaagccccgagctttggcagcagcaccaccgccagcgctacaaaacacacgccaaatgcgccacccgcccacatccacaacggcgccttgctgataaacgccatagacggcaagggcaaacgcaacgccaaaatcacgggcaacaacaccaaaacactcaccagcaacgacgccagcgttgcccacaacggatgccccagcccgcgcgcaagattgctgttgatcgcactttgaaacggcactactgccccggcaaacgcggccagcgccaacaatccggtccactgcaacgtactcatgatcaagctccacaaggttttgctggactctagagtattcgtcgcgcagatttaaattccgtttcgtcatccagaacatgcaccagatgaatgatctgcgccgtatcgacctcaacctgctggtgatcctcgacgccttgctcagcgagcagcacgtcacccgcgccgccgagcgtctgcacctcagtcaaccggcggtcagccatgcgctggcgcggttgcgcgatctgctcggcgatccgttgctggtgcgcgcaggcgcgacgctggtgccgacggcgcgggcgctggaattggtcgcgccgttgaccgaagcgctggctcaggtgcaatcgctgctggcgccgaacaccttcgatccggcgagtacgcgtcggacgtttcgtgtggcgatgtcggattacggtgcggcgattattcttccgggcttgatccgcactctgcgccgggaggcaccggggatcgacctgcaaatcagccatgccagtcgtgaaggcatgctcgaaggcgtgctcaatggtgatatcgacgtcgccgccggcgtcttcccggaaatgcccaacgaactgcgcaactcggtgctgtttgaagagcgctacgtctgcctactggatcgccagacgctgccggccaacggtgtgctggatttgccgagctacctgtcgcggccgcacgtattgctggaaatgcgcggcagcggcacgccggaaatcgagcgtgccttgacgtctctgcgtgagcgccgccgcgtcgcgatcagcctgccgcactggaacgtcgcgccgcagttcatcagtggcacggatctgattctgacggtgtcctcacgcagcgtccgcgagatcgatcagcgtgaactgatcgtggtgccgccaccgttcgagattgcgccgtttaagtttgtactggcgtggcataagcggcggggtggggatcaggcgttgaactggttgaatcggacgattgaggaggggatagtgcgcggctgaaaaaataatcaaggagcgggaagtgacaatgaagtctggctggatcggttgtgcggcattgtgcggttggttgctggcagggcaggcattggccgattgcacgccggcacccacggcacatgagatggatttttccctctgcaaggactggccggcgtatcccggactgacgctcaccgccgccgccaatttctcacccgatccggtatatggcgcgtcagggacggtggggctttacgacctgcatttgtccttggtgacgagcgcagactcgcagccgttagcgagcttttatcagccctccgcattctctgtggatgccatcgcgcttgatgaactgaaatttgataccgcccgctataagctcgcgccgcaattgcaggcctttggcgttcgggttcgattcaaaggctcttcccgtgtgaatcctctggatgaaacctggttgtcgctctatgtgaaagacggcaacgcattgcgtccggtaatggatcgactggtggtttatcaatacggcggggagtgggatggcgattgtgcaggggagcgctacgagacgatgcgaaccgtggcgttggccaagaccagcacccatggctatgccgacctgattatcaaaacgatcagtagctcaaccacaggcaagggagaggacgcggcgtgtgtatccaatactgtcgcgcagaaaccggtcttgacgacacttcgttatgacggcaaaaactacgtagtgcctgaagatttcaaaggccactaagaccgatgtcttttactcaaggaagaacaatgatctcgcgtatcaccttgctgggctcttttatcgcaatgggtcttttgactatgaccgctcaagcccagcctgtttgcgaagtgaagaagttcgacggccagtccctttcgcgctgcaaagcgtggccggcgttcaacgaccagtcgattgcggcgaaatcttcatttctctcggattcgggcgacgatgagatggggacgttcgatctggaactggcgctcgtcagttcgacaagcggcaagagtctcgctacctatgccaagccgggtgcctacaattccgatgccatcagtttcgacgatctgacaatcgatacggcccgttaccgattggctgcagatgtccgtgcattcggtttgcgttcaaaattcgccagtcatggctccagagccaatccttacgcaaaaaccgatttggcgttgtatgtgcgggagggcaacaaattgcgccctgtgctggaaggcttggtgattcgcaaggagttcggcgaagggacggatgaatgtggaaccgaggacacgcaaatccgcagaactatcgatatcggcccgacgagccaccatggattcgccgatctgatcgtcagctcgagtggttcaatttacaaatccttcctgtcggacaagaagtgcatctcgaaaactatcgagatgaagaaaactcgcgtcaccctgacctacgacggcgaacaatacactgtccccgaagacctcagaggttactgacccgatgctcaccggcctcaatcacttgaccctcgcggtcagcgacttggatcgcagcctcgccttctaccgtgatgtgctgcagttgggtgtcgaagcgacgtgggacgccggtgcttacttgtcgctgcctgggctgtggttgtgtctgtcgcaagatccgctgcgcaaagccgaggcgtgcggtgattacacccattacgcgttcagccttgatgcagcggatttctcaacgttcgtagcaaagctaaaaatggcgaacgtgcaggaatggcgggataaccgcagcgaaggtgcgtcgttctattttcttgatcccgatggacacaaactcgaagtgcatgtcggcgatctggtttcgcgactggcggcgtgccggcaaaaaccgtacgccggcatgcgtttttacgacgagtcatgatcagacacatttgtctgttatagactggcgaccacgtgatcgggcgcttgcaggttttccatgactccatcgttgttaatggccgtgctggcctcgggtttcatttacggtattacgcccgggccgggtgtgctggcggtattcggcatcggcgcagcccacgggcggcgggccggggcggggtttctttgcgggcatctgctcggtgatgtggtctggtgcagcacggcgctgattgcgattgtcggcgcccgggaaatcggcagcaccgcgtttgatgtgctcggtctgctcagcggtttgtacctgttctggctcggctggcgcgcggtgcgggcccagcggcgcaacggcgatgaaccacagggcgcggcgcgcaagccgttctggcacggcattctgtttggtttgaccaatcccaaggcctatccggtggcggtcgccacgttcaccgcgctgctatcgagccgcgccgaactgctcaactggtcgatgctgccgatgttgattgccctgagtttcctcggtggcttgctggcctacgctatcctcattggtgtggtcggcgcgcagcgggtgcgcacgctgtatcaacgtcatgagctgctgatcacccggctgtgcggggtgatgttcatcggtttcgccatcaacgcactaatgcatgcgctgcctgggctgatgccgaacaaggcttgaaggtgtgtgcagggatgcgcaatcaagaggtcagggatggttgatcagtgctgcattgcccggacacccacactgaaccatggaaagccgaaattccgcgccgttggcgagttttatagacctcttgctggacgccgtttgcgcggtcgacaagcaggggcgcttcgtttttgtcagcgccgcttgtgagcgtgttttcggctattcgcctgaagagttgatcggccggcaaatgatcgagctggtacacccggcggatcgtcagcgtactctggctgccgccaacgaaatcatgggtggcgaacccaaactcaactttgaaaaccgttacctgcgcaaggacggcagcgtcgtgcacatcctctggtcggcgcgctggtcggaagtcgatcaactgcgcatcgccgtggcgcgcgacatcaccgagcgcaagcaggccgaatcgcgccaggcagcgttatacgcgatttccgaagcggcccatgcggcggaagatctgctggcgctgttcaagcgtattcatctgatcatcggcgaatggctgccggcgctgaatttctccgtggcgctgtacgacgagcattgtgcacaactgaatttcccttatcacgtcgacgatcacgaattgcagcccgagcaaccgggaaccgtcactgggcgcttgtgcgcggaagttatccgaagcggtcagccgattcttcttacgccggacagtacagattccccagccgatttcgccgagttggtggcggggcagaacgcgccctgctggctcggcgtgccgttgaattcgaaaaacggcaccatcggcgccttgatcgtcaaaagcctgcccggcggcgagcgctacaccgagcaagacaaggaactgctgcaatacgtttgcgcccaggtcgccacggccatcgagcgtcagcaattgcacgcccgcctgcgacgtatggcgcagtacgaccagctgacgcagctgcccaatcgtgaattgctgcgcgatcgcttgaaggctgcgttggccggcgctcgcgagcaatcagggcatatggccttgttgtatgtcgacctggatcgcttcaaacaggtcaacgacacctttggtcacgccgtcggcgacatgctcctgcaaaccgtggccaaccgcctcaagggctgcgtgcgggaaactgacacggtggcccgaattggcggcgatgaatttgtcgtgctgctgcacagcgtgcaggtttcgcaagatgccgacagcgtggcggaaaaaatccgacaggtgctggtacaaccgatgcgcctcgatggccacaacctgcatatcgaaccgagcatcggcgttgcccgctatccagagcacggcagggaggagcagcaactgttccgccatgccgatcaggcaatgtacgccgctaaacgcttgaaccatcacgcgctcagtagctgatccggcggcgccgttcgtcgcggcgactgcaacttttctaaacctttgcggcccgggaaattctcaatctaggcgggcacctgctcgccacgatcattaccaagaggtagagaatcatgcctaattcaagaaactcgaactcgggaaacttcgccaacgatcgaacgaaggcctctgaagcaggtcgcaaaggtgggaaaaccaccacaacgaccgtcgacaaagagccaaaaccagacatgggccgcaagcccgctcagaaatcgaagtagtcggtgaaggtagttttgattgagaggcgggggcgtaagctcccgcttgaatttcgcaagtaaggagggcgcgaccatgagccggatggccacccgtatacgcaacatcagttttgcatcgctgttgggcctgtgtgccagcagcgcttttgcccagtcgcccgccgatttcatcaacgatgcctcggccaaaggcatggccgacatcgaggccagtcgcctggcccatggcaaggccgaatccaaagaggtcaaggactacaccatcgtcgtcatcaacgaccgcacgacggccaaccagcatctggcgaagatcgccaagaagctcgacctgcccgtcgcaccgcgtgaagaactggccggcaaggcaaaagaattgatgccgccagtgaccgagggcgcatccttcgatcaggcttacgccgctagtcaggtcaaagccactgaagaggccatcgagcagattcagcagcaagcgcagaccaccgacgtgccggagatcaaggcgtttgccgacgagaccttgccaaagctgcaaagtcatctggaaatggctcgcgcgctgcaggcaagccgctaaccagtatcaaaagatcgcagccttcggcagctcctacaccaaactttgtaggagctgccgaaggctgcgatcttttgcttttttatctaaccatcagcactcattcaaatcctgcttcggtttgcccttgtcacccaacccctcaagattaaaaacctcaccctcgcccaacgagcggtagtgcctgcgcaacgcctccaactgcttcaaatccagcgcctccagcccaagcatcgcgttctgcgcctctttcgtcaccagcagtaactcatcgatcttcaagtggaggatgtcggtgtcgcggttctgcgtgttctggatcaggaacaccatcagaaacgtgatgatggtggtcgaggtgttgatgatcagttgccaagtgtcgttgtaatcaaagaccggcccgctcagtccccacaacccgatcaggatcaatgcgcccatgaaggtcttgggactaccggccaccatcgcgagcttctgggagatttttgcgaatttcatagcggtgttccttattggaggagtgcttgaaattcagacattggcgggattgggaaaattctactgatgtgtgaaatgtccctgaaaaaccggcctcccgaccggtttcagtatcagtactctaaacctcgagttcgacgtcgacgttccagtggaagtaacccaccacctcgcactgctgattgaccagcatgaaactcagttcgcattgcacatcgccaggtttcttcggcgtgcaggtccaataatggtcgtcagcttttcgactgcccggcgttgtcgggtcgtccgtgttgggcgcgggcacggtcaggtcggtatgaatttgcaagtcaggttcggaaagcacgtcgctgtcagccactgtcatccggtacacaaccacactgtgttcggcgatcaggctgacggagcgtccgcggaagtgcaggtcgcggtcaatctcaacggggattgttactttgctgtcatttatgactatatctttcgagtcattacctatggcgaaaaagatcagcccatcggtaatgctcgtcggtgcggcggcgtccaggcttgggttcggataacgcgccagtactgattcagcgtcgacgatcagcagcacattgtgtgcgctggtaacgccggatgatggtgacggaatcggttcgctagtcatcatggcttcctttcatgatgttggcaggaaacgacagccgcttcggtcaaggcaagacatcctgttccggccggggcggcgacggatcggtcgggccccctgtctccaaggggctcggagcgtcatcagttgtgaatggagatgaacggatcccacgagcagcagccgatgatctggcagttgcgatcgacgatcaggaagtggaagtgatacgtcacgcgaccacagtccagggtttcggatgaccaatagtggttgtcgactttctggcagcttggcacggatggattgcttgtattgggcacagctacgcacgctgtggccttgcgcggggaggggggcgagatcaggttctccccggcgttggggatgaatttgtagaaaatcaccgcctgttcgaagctctgcgacaggctggtttcgcgccagcgaatcagatcgccgacctgagccttgaggtccagttcgccaccggcctggccactgacgacgttgtcctgattggtgaccatgtacacatgtttccaatcgatcagcgtggggttcttcggatccttgctgatgtttggatactttttcagaatggtttcggtgtcgatggaaaccagaatatccgtcactcgagacatggtgatgctcctttttcatagtgaacgtcgaactgcaatccagtcacgacgatgcttgcttgccgtatggcttttgccagcacactactgggggaacccactgatcacgagaaatggacaggccgtgctccttgcacgaaatcgactgattcgggttccttccgattgccgctccttgactataggtacgattttttagctgtcaaaatcgcttttgtccggctcgacggacggtcgccgaatccagaaggtccgacctattggctataagcaggcaggccggtctgacaccgtttgaaatcgagccgctgtggaactgctcgctgcgcaccctgtatcgtgacgaaccgctgaaatgtcccgacaggagaacgcaatgagttggtccgccaaacaatacgtcgctttcgaagatgaacgcacccgcccggcccgtgatctgctggcggcgattcccacgcctgaagcgcgaacagtggtcgatatcggttgtggtcccggtaactcgacggagttgctggtgcagcgttttccgggggcgaaaatcagcgggctggatagctcggcagacatgatcgacgcggctcgcaagcgcttgccggatttgcgcttcgatgtcgccgagattgataaatgggccgattcaggcccgttcgatgtgatcttcgctaatgccgtgttgcagtgggtgccggatcacgcgacgttgttgccggcgctggccagcaagttgtcggccggtggcagcctggcgatccagatgccggataacctcaatgaatcctcacaccgcttgatgcgtgaagtcgccgcgaatggtccgtgggcgagcaagctttcaggcgctgcggggcaacgtaccgacatggcgagtgccagcgattatttctcgatgctgcgaccgcactgttcgcgggtcgatgtgtggcgcaccacctatcaccatcagctgtctggcggggcggcgggggtggtggagtggttcaagggcagcgggttgattccgtttttgaatccgctgaccgaggcggaaaaggcgcaatacctggagcaatatctggcggaggttgagaaggcttatccggcgctggcggatgattcggtgctgttgccatttcccaggctgtttatcgttgcgacacgttgaaaagagtcggacgtgttgttcggctgggaatttcgggtgcgctttcggacgggcccctcatcgggacgccgcccgcccagccctctccctagggagagggagagggagccgagttgttgtttccaaacctgagttcgcctcgattttgcacgtcggcgtagctcaggagggcaactcggtcagtcccctctccctctgggagagggctagggtgaggggctttaagctcagcgctgcaccgccaccaacatcatcatcggccgttcccgctcttccgccagcgccggttgcgccgcgatttcagcatcgctcggcccccattcattgacatgtcgaatcgtgaaccccgcatcgatcagcgaattgagcaatgtcccaaccgtacgatgctgcttgatcacgccctcagccagccagttcgtcacccgctcaccctccaactgataactgtccagcggccaacgcttgttaccttcagcgtcaatcaaccaacccggattgcgcggcgccatgaagatcggatgctcaatggaaaacacaaaatgcgaacccggtttcagcgccgcgtacagccgcgcaaacaacccgggcgaatccttgatgtaatgcagcgccaacgagctgtaagccaaatcaaaactacaggcgggcagctcgagctgttccagatcggcgcgctcataactaatgttcgtcgccgtcgtggtctcccgcgcccgctccagcatcttctccgagacatccagccccaagacactggccgcgccattctcaatcgcccagcgactgaaccagccataaccgcagcccagatccaccacattcaaaccgtgcatggatggcaacagcgtcttgagcgcaggccactccggcgccgcgtcgaggccgccgatggagcggttcatctggctgtagccttgaaagaattcgggatcgtcgtaaatgttttgcgtcatggtgaagtgctcttttgagttcgatcgtcagcggcaacgtggccgcgattggaatccctcgaaagtgatggcgcgtattcgtcgatggccgcgcagggggagggtggtggtcgatggggaaatgctagtcggttgggcgagaggtgaaaaccggtggagtgttgtgggtctgtaatgtcggggaaaacgctatgttttatcgccgcgtaaacatcttccgggcgaagtgtttaaaggcgtgcagtgttacgtcctgaagcctacaaatccttgcgccgttgcctaccgctaagccagactccgccggcttgtgcgctttaggggcggtcggtaacttggttcgcgtcactgatttccagtgatcgggtttagtagcccggaatcctcaatctaaatagctgcatgagtaccactcagtcaggcgaatgcttgcacctgatggtggctgtgcgcatggcgccctcgggtgcgccggatttggattggggtccggtctactaacttgcgcacagctgccacccatccgtttagtagcgagatcggttgcggccttactaaaaggtctcaatccaatgttcaaagttacgcccaatccgccggaaaccgatccggcatccccctacgaatcacccaactcaaagaaattccacgaagccgccgaacgcgccctcgaccactatctcagccctacggccagaatcatgggttccacccacgaacccgaaccgatgtacctcgccaaccctacctacgacaccgagtctctgctggccaacgccagcgaaaccctcggctcggccaccaccatgctcaacaacttcgccgcgttgctcgacacctcacaccgcaagactgcactcggcatcgcgcaggtcgtcatgttgggagaattggcggtgaatcaggcactggataaggtcgtgccagcggggtaatcacaaaatcgtcgaggtgtagcagacacaaaaaaaccggctctaaaggccggttttttgtaattgcggctacagacattcacgattcaaggcgccaacatccgcaacgccgccgaagtcaaaaacgccgaacgattcttctcctccggatgatggtgaacgtgaagatcaatgcgctcaagcaggtagcccggcagcgtaatactcacttcttgcggactcccgaggcaccgaccgacatccgcgtccaccaacgcccaaacgcagcctgcgtatttcggattggagaagtgagttccaggtttcccagcgaccggaatggctgcaccactttccgccagaatttcgatgtgggcctctatggccgcttttgccatctcaatggcatcctcttgatcatctccggcagaaaaacatcctggcagatccggcacctcaacaccccaggcacactcaccgtcactggcagagattgcgattggatagagcatctggataatccccttgagcacgcagcgcttcttatcgttagagagatcaaagggtaaggggagatggcgtatctgcaatcaacggtgtgtttctgaatggttctgcacccaattggcaaacctcaaatcccagccacaaaaaaaccggccctatgggccggtttttctatcctgcatcccccgtcaaaatcacaacgtgagaccaatattcgagtggagcgggtagagggaatcgaaccctcgtcggaagcttgggaagctactgttctaccattaaactatacccgctcagagcggctgactttgtaccagactcggccacggatttgaagtttttcttttactcatgaacgctttgaatcactgcaaacggtcaatcgcgggcgagcactgcggtgagaaaagcaaaatcccaaccctgcagtctcgcgcgcgatgacactttttcaaatggcgaatgcatgttgatcctgaacaaacgagtaacgcgttcggctggtctgctgcgccggtttcagaaagccgagcagggcgttctggctatcgcggcaagcggccttgtgctccatatcgagaaaatgcccggtggcttgcagcgtggtgaacgtgctctgcgccacgtggttgccgaacaggcgtgcgtcttcggcagcggtgtattcgtcccattcgccgtttagaaacagcaccggcacgttgatttttttcgctgcgttcagatagcactgccgatcgctgtgcagtacgtcgctgatgtggaagtgcatctgcccgtattcgtgctcggcgaggctgctgacgtggcgataattgaagcgtttgaacagtgatggcaggtgtttgccgatggtgctgttgaccagatggccgacgcggtcgccgtcgcgctggccgaggtagtcgacaccgcgttcgaggtagtcgagcatgtgcgcgttgatcactggcgagaacgagctgatcaccgcccgttcgatgcgccgtggctggtgggcgagggcgaccagggttgcggcgccgccccaggagaacgacagcacgtgttcggcggcgaagtggtcgatcagctcgagcagaatctgcccttcgacgtccttggtcagatgtttctcatggcggttgtgggcttttgaccggcccgcgtagggctggtcgtagcaaaccacgttgaattgcgggtgcaggtttttcacagtctgtgcaaacgacgcagtcgtggccatcgagccgttgaccaggatgatggtcttttctgcggcgtctgcgcgatagaactccgtgtaaacccgatactgaccctgtatatccagcacagcgatttctggcctcatgtcataagactcctggcaagcaagcgggtatgcgcgcaaatagacattgcacgagctttgtgacaggtaggcatacgcctggaatttgcttggcccatgtcgatccgttacggcaggtcgacgggtattgttattggcgggcagtctgccggctgaggcgaagccctgaggcttacgaccggcaaaaagtttcttagaagtatgttgtgactcatcggtcacaatctggccgacgtcctgattcaagcaggggagtcggaatcgcgcaagtgccgttggtaaattgttcgacaacttctgctgagcggtcgccggcttagaacaaatggatctcttcggtgcgcaaagcgcggtactcgcccggttttagcgcgttatcgagcagcagcggacccatggattcacggtgcaggcgcaggactttgttgttgaaaaagccaaacatgcgcttcacctgatggtagcgaccttcaacgatgctgagccgcgccgagcgtgggcctagcagctccagttgcgccggctgcgtggtcaggtcttcgaaggcgaagtaaatcccctcggcaaaggtgctcgcatattgcgcgccaatctcctgctcggtctcgacgtaatagaccttcggcaatttggtctgcggctgggtcaggcggcgcgaccacgcgccgtcgttggtgatcagcatcagaccggtggtgttgaagtccagacgtccggcgatgtgcaggtcgtccttgtccggttcatcgatcaggtcgagcaccgtcgggtgttgcggatcgcgggtggcgctgacacagcccggtggcttgtgcagcatgaagtagcgtgccggtttgccgctttgcaggacttcgtcatcgacttcgacgcgactgaaatccagcacctcgctgtgcggatcgctgacgatttttccgtcaatccgcacgcgcttttccaccagcaacaggcgaacctgctgacggttgtagcggggcaggttgctgagaaaacgatcgacgcgcatgttcagagttcggtgaatgaagggccgcgcatcttacgggatcggccgcttggccgcttgcagttgcgcctcgacctgcgcgcaacgcgggcacaggcaggattggttgcgcagcgctggcggcagcgcttcgagcactgccgggtcgatgctcacgccatagcaccagcattcgcggtcggcggtgcgtgggtcggccaggctgcagtcgttacgggcgccgcaggccgggcaaaggtcgggtttaacgtcagaatcaggcataagtcgagtgaggcatttccacgcaggtgcgattgcggccggtttgtttggctcggtacatcgcatgatcggcccgcgacagcaggctgtgcaaggtgtcatcgcgttgcagggcggtggcgccgatgctcacggtcagatggagtcggtggccgtcgtaggtatattcgtgttgttcgacgtgttggcggatcttctcggcaattttctgaccggtgtcgccgtcggtgtccttcagcaaaacgatgaattcctcaccgccccagcgacagacaatgtcggcatggcgcaggcagctttgcagatcgcgagcgaaaccgatcaacacctgatcaccggccatgtgcccgtaggtgtcgttcaacgctttgaaatgatcgaggtctagcagcaacgccgtgagcggtttggtttcgcgttgcgcttcgtgcagagcctgtgcggcgagaatgtcgaagccgcgacgattcggcagttcggtaaggctgtcgagggtggcttgagcctgaattttgctttgatagcgcttgatcacgcggttgagcagcgccaacacgatcaatgtcaccaacaggcagatcagcagattcaaatacagcgagtgtttgatttcactcagtgcgccgtcttcgcgtttatcaacaaacaggtaccagttcagctccgggataaaccgcacgttgagaaaatgcccttgcccgtgggcggaatactcgtagctgccgctgtgaggtttgggcaactggctgaccaggcttttcatgctttcaagttcgccgaggctctggccgatgcgcgcaccttgcgggccgccttcggcaccggtcagcaccaaccggccaaaggtgtcgacgaagtacacgctgcgttgatagcgctgttgatacttgtcgatcagcttgatcaccgcgtccacggtcagaccgaccccggccgcgccgatgaagcggttgtggtagtcgtaaaccttgtagttgatgaagaaggtcaggttgtccttgttggccagatccgggtcgacgttgatctcgtacggatccttcatgtcgcgcacgcggaagtaccaggcatcgcgcggttcatcgaccttgacctgcttgagcacgcctttggcgtggtagtaagtgagggtgctgttggagacgaagaacgcggtgtaggcgccgtaatgggtcatgacctcgtcgaggtagcgggtcatttgctcgggattctgctcgccgttgaccacccagtcgcgcatgaaggtatcgcgggacatcatcgaggagatcaggattggccggacgaggtctttctggatttccgagtagaccgtatcggacgtcaacggcagttcggtgttgacgatgttgtcgcggatcgaggcgcgggaggcgtagtagctcagcaaagacgtggcgagaaacccggcgccgagcagggcgatcagtgtcaataccagcgaacgttgggagtacagcgcagatcgatgcggcatggcagttccgttggcagtggcccgatggcaagcattctaatggcaccacggggaaataactgctccatgtgcggcgcgaatggtcgttcctggcgcaaagccaatcttgtaggagtgagcctgcgcgcgattgcagtgtgacattcagtgaagatgtggctgatacaccgtcatcgcgagcaggctcactcctacaaggttttgcgatggcgcggacaccgctgatctgaagccatcgcggactgggcacttgattgatccgccccagtcaaacgtgtgtcggctgctctgttccgttgcggccgtgggtctttcaggaggccgccatgcgtgttcagaagatgttgctcggcgcggttctggttttcggtttgtccggttgttattactacgccggcccttacgatgcttaccccgccacctactactatcccggctattactcgcccaattactacggtggttattacggcccgcgttactacagcggcccccgctattactacggtggctacggttatcgcggcggttacggacggggttatcacggcggcggatatcacggtgggcaccattaatcagtggctgaatgacggcgttttgcggatgaataaggtttcatagatcacttgtttcaacttgttgcaggaacgcaccagatgccaaaaacgctgtctgatttttcgacagtcaccgattaattgactgtcgcctgccagcgtcgctggtgtggccaacccgcggtccaggaggccgccatgtatagacgaattcttctgcttgctgcgttgatgttttccgttgccggttgcgtcccgtactcctacgcggactcgtattacagctcagaggtctacacatcacctgcaccggcctactacaacacgggtggcacgtattacaacggtggcagcaggtattacgcgcagccacgctattaccaaccagctccgcggtattaccagcaaccgcgctattaccaatcggcgccgcgttactatcaaccggccccgcgtcactacgaaagccgtcgctggcacggcaatgatcgcggccgctgggatggccaccgtcgtggcggttgggataacgatcaccgcggtcgtggcaactatgaccgacacagtggacgcggtgaccacaatggacgtggcaaccgctggtaatcacctgccaacagaaagcggcgcataaagcgccgctttttttgtgcctgaatttcgtccgagaaagtcagtactgcgtcaaatccgccaacggatgccgcccctcccagaccttgtgaaagtgcgcctcaaccaccgcttccggcacatggttgatatccggccaatgccagtgcggcttctgatccttgtcgatcaatcgcgcgcgaaccccttcgctgaactccgggtgccggcagcaattgaggctcagggtgtattccatctgaaagacttcagccagcgacatgtgccgggcacggatgatctgttcccagaccaggtgcgcagtcagcggcgagccttcgctcatggttttcgccgcgcgggcgatcagcgggtcgctgctgtcgcgttgcaggctgatggctttccacgcacaggtgacgtcactgacatccagcaactcatcaatctgctggcgacgcggcagccactgcgcttcgggcatttgcgccacggcttcctgctgcaaagccttgagcaggctgttgagctgcatgtccgtctgttcctgccaattgagctgcagcaggccttcgatcagttgcggctgctgttcgtcgagcaggaagcggtcggccagatccagatcgatcgcatcccgaccattcatgtgcgcaccggtgaggccaaggaataatccgagcttgcccggcagccgtgcgagaaaccaactggcgccgacgtcgggatacagaccaatggtgatttccggcatcgccaagcggctgcttggtgtgacaatccgcgtactggcgccttgcaacaggcccatgccgccgccgagcacataaccgtgaccccagcagatcagcggtttcggataggtgtgcaggctgtaatccagacgatattccgcgctgaaaaactgcgcggccagcggtggtacttcgccggggtgagcgcgacaggcttccaccaggctgcgcacctcgccgccagcgcagaacgctttggcgccattaccgcgcagcagcacgcagacgatttgcggatccttggcccaggcgttcaacttgtcgctgagggcgttgatcatcggcaaagacagcgcgttcagcgacttttcagcatccaggctggcgataccgatgcgggcgccgtcggtgccggtgagttcttcgaagtgcagattcatcgtgacctcgatcgggaatttgaacgatcagtatgatcgctgtgggggaaagtgccggatctgcgtcagatcaattgacaagcgtggccggctttcctagggttcgccccattgtttttgccgggtatgaccatgactgctgacgaccgtatcaaactcgaaccgagctggaaggaggcactgcgtgctgagttcgaccagccttacatggcagagttgcgccagtttctgcagcaggaacgggcggccggcaaggaaatctatccgccggggccgatgattttcaacgcgctgaattcgacgccgctggataaggtgaaagtggtgatcctgggccaagacccgtatcacggcccgggtcaggcccacggtttgtgcttctcggtgcagccgggtgtgccggcgccgccgtcgctggtcaacatctataaagagttgaagcgcgatctgaacatcgacattcccaatcacggctacctgcagagctgggccgatcagggcgtgttgatgatcaacaccaccatgaccgtcgagcgcgccaacgccaatgcgcacaaggacaagggctggcagttctttactgaccggatcattgaactggtcagcgagcgccagccgcatctggtgttcatgctctggggcgcgcatgcgcagagcaaacagaagctgatcgacgcgaccaagcatctggtgctgacgtcggtgcatccgtcgccgttgtcggcgtatcgcgggtttttgggttgcggacactttggccgcactaacaagtttcttgagcagaatggcgagacgccgatcgagtggcgtttgccgccgatttgaaaagcatcgcgagcaggctcactcctacagttggaatgcgttcccctgtgggagtgagcctgctcgcgatgggggcaactcggttttattcgggattacgattccagtacttgaacaacggctccgccagaaacagcacaaacaacaaccgcatcacctgcatcgccgtcaccaacggcaccgacagttgcagggtctccgccgtcagactcatctcggcaattccgccgggcatcatgcccagcgtcagcgagcgcagatccagatgggtcagcgcactcaaccccaacgccgccagcgtggcgatcaacatggtcaacgccgtgccaatcaacgtccgccccatgaaggaaggcgcgcggcggaagaactgccggttgaagtgacagcccaagccgctgccaatcagccactggccaatctgactgccaccattgggtaaaccgatgtgcaaatcccagccaatgctcaccgccgcgctcaccagcaacggcccgaacagccacggattgggttggcgcaaacgctgccagagccacgcgagcaaaccacccgccggaaacagaatcgccagccagcgccaatcgacgctgcctgcgtgagaaatcgggttgccatcgccgagcagatacttgaacgccgccggcacgcacaacaccacgaccagcactcgcaaactctgccccgccgcaacgtggctgagcatcgcgccattgcgcgcaccgaggttgaccatctcgccggaaccgccgggcatgctcgagaaaaacgccgtggcgcgatcctcgccggtacgacgcatcaaccacacgccgaccaccgccgacacactggtgaccagcgcaccgaagaagatcaaaccgaaatgactgagcacctgctccatcaccagcggggtgaagtgcaggccaatgccgatgccgacaatccactggccgcacttgcggccgccagggatttccgtgagttgccacggggtcaggcagcgcacgaggatgatcgccagcaatgagccgaccatccacggcagaggccagccgatctggctggcgaggtaaccgccgagcagaccgaccagcggggttccccaccaggatttcagtgagtcgcgatcaaacatcggcaatggcgcgacgcgcgaccgaacgtttgcgccagatgcgaatcagcgggaaggccagcatcaacgcggtcagcacccagacaccgaaggtgatcgggctagaccagaggatttccagcgcaccgttggaaatcgacagcgcacgacgcaggttctgctccatcagaccgccgaggatgaagcccagcaataccggcgacaacgggaagtcgagcttgcgcaggatgtaaccgaagatgccgataccgaccatcaggaacaggtcgaaggtggtcgcgtgtaccgcgtaaacgccgatcccggtgatgatcgcgatcaccggcaccagcgcccagttcggcacggcgaggatgcgggtgaagatgcggatcatcggaatgttgaggatcaccagcatgatgttggcgatgaacaacgacgcgatcaggccccagacgatgtccggttgttgctggaacagcagcgggcccggggtgatgttgtacagcgacagcgcgccgatcatcaccgcggtggtgcccgaacctggaacgcccagcgtcagcatcggtaccagtgcgccacaggccgaagcgccaatggcggtttccggagcggcgaggccacgggcatcaccctgaccgaatttgccgctggcaccggcaatgcgtttttcggtcatgtaagccacggcgctggccagcgtcgcgccggcacccggtagcacgcccatgatgaacccgagcaagccgcaacgaatgttcaccacgaacaccgacgaggcttccttgaaattgaacatcatccgcccggtggctttcaccgcttcctggccgcgatgggttttctccagcagcagcaggatctcgctgatcgagaacaggcccagcaccagcacgacgaattggatgccgtcggtgaggtggatgttgtcgccggtgaagcggtacacaccgctgttggcatcgatgccgacgctcgacaggaacagaccgatcaacgcagcgatgaaggttttcaacggtcgatccccggccatgccgccgaggcagacaatcgcaaacaccatcagcacgaagtattccgccggcccgaaagcaatcgcccatttcgccagcagcggggcgaacagcaccatgccgcaggtggcgataaacgcgccgatgaaagaactccacgccgacagcgacagcgccacaccggccaagcctttacgggccatcgggtaaccgtcgagggtggtcatcacggtcgatgcttcgcccggaatgttcagcaggatcgagctgatccgaccgccgtattcgcagcccagatacaccgccgcgagcagaatcaacgccgattccggcggcaggccgagagcgaatgcgatcgggatcaacaacgccacgccattgatcgggccgaggcccgggagcaggccgacgacggtgccgatcagcgtgccggtcagggccgtgaccaggttgtacgggctcagcgcgacgccgaagccttgacccaaataaccgagggtatccatatcagttctccagcacgtcgagcaggccaaggggcagcgggacttccatcacgcggtcgaacagcaggtacagaccgatggccatcagcgtggtcaccacgatgctcggcatccagcgaccgccgtacaggcgcgccatcggaatgccgatgaggatgctgctgaggatgaaacccagcggttcgaagaggccggcgaacaccagcagcagtgcgacgcaaatggcgatcttggtcagggtttcgcgatccagtggcggctcgtcttcactgtgtttgatcggcgccgggcggaacaccatgtacagcagcgccgcgcccatcaggccgagcatcagcagagggaaggcgcgcgggcccaccggttcgtaggaaaaagccgcttggtacggccacgccatcagtgccagaccggcgcaaaccagcaacagcacggaggcgaaaatgcgttgaataagcatgggagctcctgtgccgcgtccccgcaaccgggaacgcagccgctagacagagacgatcactggatcaggccgaactctttggccagcactttgtagtccgcgacctgcttcttcacgtaggtgtcgagttccgggccggtcatggcgaacgggaacagttcacgctgatcgcgcagcttggcgaactcatcggaggccagcagtttgtcgaacgagtctttccaccaggcgtagtcttcatcgctgacttttggcccgaggtagaaaccgcgaaccaccggccagacgatgtcgtagccttgctcgcgagcggtcggaatgtctttcatttccggctcgtcgagacgcttgtcggcgaacaccgcgagcagacgcatgtcaccgctctggatgtgcggcatggagtcggagatgtcggtactgccgacctggatgtggccaccgagcagggcggtggcgatttcgccgccgccttcgagggcgacgtaacgcaggtcacgcgggttgatcccggcagccttggcgatcagtgcggtttgcatccagtcctggctgccgacggtgccgccggaaccgatcaccaccgagcttggatctttcttcagcgcttgaacgagatcgtcgagggtcttgtagggcgaatcgcttttcaccgcgatggcgccgtagctggtgccgaccgccgccagccagcgcacgttggtttcatcgaagcgaccgaacttgccttgggccaggttcagcaacgaaccgctcgaccatgcgaccagcgtgccggcatcggcagggcgctgcgcgaccacggcgttgtaggctaccgcgccgacaccgccgggcatgtaggtgacgcgcatcggtttgctcagcagcttctggttgaccagtgcgctctgcaccagtttgcaggtcaggtcgaaaccaccgccgggggaggccggggcgatacattccggacgtttcggttcagccatcagttggccggcaaacaggatgcaactggcggccagtgcaactttacgcagtgacaggttcattcgattctccacgggcattgttgttattcgacgtgtttttcacttacgggcatttaccaaagggcaacgctgtagctcaccagcaaacgcacttcgtctgcatcgcgagccgagtaattggagcggtaagtggcattacgcaaacgcacggcgacatccttcaaggcgccgctttgtactacatatttgatctcggtgttgcgttcccactctttgccttcttcaccgttcttgagcttgatgttgtcaccgctcaggtaacgactcatgaagctcaggccaggaatgccgagcttggcgaagtcgaaatcgtagcgcgcctgccaggagcgctcttcagcgccggcgaaatcgttgatctgcacgaagttgaccaggtacgggtcgctgccatcgacgtacgggaaggcactgtcaccggacatgtgctggtaaccggcgctgaacttgtggccgctcagcgcatagctgaccagaccgttgagcgagcggttgtcgatctcgccgccacgggccgcgccctggtcatcgctgacggcgaaacgcagatcggtggcaaacgtgccggggcccatcggccgcgaagcaacgaggccgaagaagtgctggttgtagacttcgtcgagttgggcgaagtggtaactgccggtgatcttgtcggtgaacttgtagtccactccgccaaaatcaaagtgcttgccggcagcagtgccggcaaaacggctgttcttgttgttgagggcgatgtcctcgaaatcggtgctgtcgcgatccttggctttttccagacggccgccggtgaaggtcaggttcctgatctctttggaggtcagcaaaccgccttcaaaggtctgcggcaggatgcgcccgtcattgggtttgaggatcggcagttcgggaatcaggctgccgattttaagttcggtggcagatattttcactttgccggtcaggccgactttggagtactcatccgccgcgcgcccgtcgtcgtgggttggcagcaggccggtgccggtgcggtccggactcgaatcaagcttgacgccgagcatgcccaacgcatcgacaccgaaccccacggtgccgtcggtgtaacccgattgcagattgagcatgaaaccctgggcccattcgtcacgcttggattgctgcgcgctggtgccatcgcgaaagtcgcggttgaaatacatgttgcgggtttcgaaggtggcgctgctgtcttcaatgaagtcggcaaaactcagcggtgaaaaaccggcaagggcggcggcactggcgagggcggtgtggctgaaacgggaagggcggacaggcgtggaagcctgaggctgcatggacagcatgcgggtgtactccgtttattgttcttattggtcgaaaacgcttcgtggcgtttttcgtagcgctgtgtggcagcagcgacggcagtcgggactgtccgtgggccgactctaaccggctaacctttcactaacctttcagctgactttcacggttttcgggcttcacagcggcggttgcggctgtaaactccgcggcaaagcgtggcgtcggccatccctgaacgaggtaaaaatccatgcgtgttctgctcgtcgaagaccatctgcaactggccgaaagcgtcgcccaggcgctcaagagcaccggtctgaccgtggatgtgttgcacgatggcgtagccgccgacctggccttgagcagcgaggaatacgccgtggcgattctcgatgtcggcctgccgcgcatggacggttttgaagtgctggcgcggttgcgcgctcgtggaaaaaatctgccggtgctgatgctcaccgcgcgcagtgatgtgaaggatcgcgtccatggtctcaatctcggtgccgatgattacctcgccaaaccattcgaactgacggaactggaagcgcgggtcaaagccctgttgcgtcgcagcgtgctcggcggcgagcgtcagcagcgctgtggcgtactcgcctatgacctcgatacccgacgcttcaccctcggcgaagaattactgacgttgacctcacgcgagcaagcggtgctggaagcgctgatcgcccggccaggacgggtgatgagcaaggaacaattggccgcgcaggtgtttggcctcgacgaagaggccagtcccgacgccatcgaaatctacgtgcaccgtttgcgcaagaaactcgacggtcaaccagtggcgatcgtgaccttccgcggcctcggttacctgctggaaagccgcgatgcataagcccagcagcctgcgctggcgcttgctgtggaacctcgcgttattgctggtggtgttgatgctcgccagtggtttgagtgcttactggaatggtcgcgaagccgccgacactgcgtatgaccgcacgttgctggcttcggcgcggaccatcgctgcaggtctgtcgcaacgtgacggcacattgagtgccgatgtgccttacgtggcactcgacaccttcgcttacgacagcgccgggcggatttactatcaggtcaatgacatccatcagaagctgatttccggctacgaaaacctgcccggcccgccgccggggacgccgcgcacggacagctatcccgcgttggcgcgcttctacaacgccacctacaaagggcaaaacgtgcgtgtggtcagcctgctcaaggcggtgaccgaaccgaacatgaacggcatggcggaaatccgcgtcgccgaaaccgatgaggctcgggtaagcatggcgcgcagtctggcggccgataccttgctgcgattgggtatgttggcgatcggtgcgttgctgttggtgtggttcgcggtcagtgcggctttgcgcccgttggagcgcttgcgtacagcggtggaagagcgtcagcccgacgacttgcggccgctgccattggttgaagtgcagcatgagctgtggccgttggtccgtggactcaatcatttcaccgagcgcttgcgcgggcagttcgaacggcaggcgcagttcattgccgatgcggcccatgagttgcgtacgcctttggcagcgctgaaggcgcggcttgagttgggcctgcgctccaacgatgccgaagtctggcgctcgacgctggagtcttcggcacaaagcactgatcgcctgacccatctggccaatcagttgctgtcgctggcgcgggtcgaaaacggcgcccgggcgatcgccgagggtggcgcgcagttgctcgatctgagtcagttggcccgagaattgggcatggccatggcgccgttggcgcacaagcgcggggtggcgctggcgctggaggcggacgaacccgtctggctgcgcggtgagccgacgttgctgaacgagttgctgagcaatctggtggacaacgcgctggcgcacacgccaccgggcggcaatgtgattttacgcgtgacggcgccggcggtgcttgaggtcgaagatgacgggccggggattccgctggaagagcgcgatcgggtgttcgaacggttctaccggcgtaatcagcaggtcgcgggttcggggctgggattggcgattgtcggtgagatttgccgggcgcatctggcgcagatcagtctgcatgatggcgagcaggcggggttgaaggtgcgggtcagttttattgccgggtgacttgcagtgtttttgttggcctcatcgcgagcaggctcactcctacactggaacacgttctcctgtaggagtgagcctgctcgcgatggccacaataaggtctcgaatcagtaaaacatcgtccgcgactcttccagatcttcacacagcgctttgttctcctgatcgatcccaagcttgcggaacgccggaactgtcattggatcgatccgcgcaaacggatgatcagtgtccttgtggcaatacaggctcgccacctgcaccagatcgacgtaatcaatggccgtcgagtcgcgcttgaagtcctgatagcgccccggcaattccaccagacgttctggaaactcccagacgcgcaggagcttgtcgcccagcaacggatgaatgtgatcgatcacatggttgaggctgaccgggtccgacagcagttcgtagtggtcttcggcgtaggtcagaatcggcaacacgccgatctggtgcaccaagccgccgagggccgcctgatcaggcttgagttgcgtgtagcggcgacacagagcataactgaccccggcaatttccaggctcttgcgccagacttcgcgcatcttctgttcgaccacttcggagcgggcgtggaaaatctgctccatcaccagaccgatcgccaggttgctgctgtagttgatgcccagccgggtgatggccgtgtgcaggtcggtaacttcctgggcggcgcgcagcagcgggctgttgaccactttgatcaggcgcgccgataacgccgtgtcccggccgatcactttgctcaggtcgctgacgctgatttccgggtcttcagcggccttgcgaatctgcagggccacttccggcaacgtgggcagaaccaggtcatcgttatcgatggcctcaaccaaatcctgttggactttttccgccagttcgctcatttggactctctagggtgttgcaacaaatgctgcgatcagcgctggatttcgcggtcgcgatccagtgcgtaaggcaggtcgagcaagtgcagcgccgggccttcgagggaacccacgtgcagatcgcccgattcggcagcttcggcctgcagcaccgccaggagttcaatgttttgaccggcgttggcggccaggaccacttcgccgatcgagctgttgtggctcggcgcgaacaatggtgtgccgggctgcggcaaatcagccgtgtcgaggctcaagcgatacagacgacgcttgagtttgcccaggtactgcatgcgcgcgacgatttcctggccggtgtagcagcctttcttgaagctcacgccgccaacggcttgcaggttgagcatctgtgggatgaacagttcgcgggtgctcggcatgacctgaccgataccggcgcggatctggcccagcagccattggttcagttcgccttccggcagtgttacggcgagtctggatttgatggcgtctgcctgatcggcaggcacccagagttcggcgcgatctggcgagacacgaatggcgatcagaccttcatggcgcacgacgctgtcggtatcgaccggcaaatccaggccgaggcagctcagggcggcatcgccttgcaccagaccaaagcgcatccaggcagcactttcgtcggtcagtttcgatttggagaagactgcgtattttttcaggtccgccaattgtggttccagcaactcgctggccatcgccagcaccacgccgtcaccttcgagcagaatgcggaaactcgactgcatccggcctttctgcgtgcagcgcgcgccaaggctggcctttgtgtcactcagataattgaggttgcaggtcaactggccttgcaggaatttcccggcatccgagccgcgaaccgcaagaacgccttcatgagacagggtgcagaaaaaagcagaatcggccatgggtcatcgcagggtaaatagactggggcacatcataagggtgcatggttgaaatgggtagttgataaaggatcggtggtgcccgaccaaagccgactgtgcgacctgcgccggggctgtatacttgccggcaaatttgaggagggctccatggtcgaacaagttgaactgaatcgcctgttttggcacagccgtcgcggcatgcttgaacttgacgtgttgctggtgccgttcgtgcaggaggtttacgcgacgttgaaccaggtggatcgcgatctgtatgtccgtctgctgacgtgcgaggatcaggacatgttcggctggttcatggagcgcagcgagtctgaagacccggagttgcagcgcatggttcgcatgattctggatcgtgtccagcccaagtaatacgttcgaatgccgctggcatgcctctgggcagttgctggcggcgtatctgctggcccaggcgttcgcactgggtgctttgtttctgctttcgattccactctgggccagcctgctcggggcttttgcctgtctgcttcatgggttttggacgttgccacggcagattttgctgactcaccgaatggctttttgcggattgcgccgcgatgccgatggctggcaactgtggaatcaagccaatggctggcaaaccgtgcaattgaggccggacagcctggcgctgccgttgattgtggtgttgcgctttcgtttgcgcggggaatggcgggtcaggtcgatctgcgtaccgcgagattcgcaggtcgccgatgtgcatcgacgcctgcgcgtgcggctcaagttcagccgacgtaggtgggcggcaccagaatagtgtcgagcgcctcgggcaacatgtccgggtagtcgagggtgtaatgcaggccgcgactttccttgcgttccatggctgagcagatcatcagttcggcgacttgagcgaggttgcgcaactcgatcaggtcgcggctgactttatagttgctgtagaactcgtcgatctcgtccaacagcaaacgtacgcggtgttgagcccgttgcaggcgcttgttggtgcgcacgatgccaacgtagtcccacatgaatcggcgcagctcatcccagttgtgcgcaatgatcacgtcttcgtccgagtcggtcacctggctggcgtcccacgcgggcagggcgcttggcgcggcgacatcgtccagttgcgcgaggatgtccgccgcggccgaacgcgcatagacgaaacattccagcagcgagttgctggccatgcggttggcgccgtgcaggccggtgaagctggtttcgccgatggcatacaagcccggcacatcggtgcgaccttgttgatcgaccatcacgccaccgcaggtgtagtgcgcggcgggtacgaccgggatcggctgcttggtgatgtcgataccgaaaccgaggcagcgctcatatacggtaggaaagtgcgtcttgatgaagtcttcgggcttgtggctgatgtcgagatagacgcagtcgacacccagacgcttcatttcatggtcgatggcccgagcgacgatgtcgcgcggtgccagttcggcgcgtttgtcgaagcgatacatgaagcgctcgccgttcggcagcttcaaatgtgcgccttcgccgcgcagggcttcggtaataaggaagcttttcgcttgtgggtggtacaggcaggtcgggtggaactggttgaattccaggttcgccacccggcagccggagcgccaggccatggcgatgccatcaccacaggcgccgtcggggttgctggtatagaggtaaaccttggccgcgccgcccgaggccagaatcacaaagcgtgcgccgtaggtatcgacttcgccggttttgcgattgagtacgtaggcgccgaggcagcgctcgccttccatgcccaaacgacgttcggtaatcagatcaacggcaacccgctgctccagcaactcgatgttcgaacgctctttggcctgagccagcaaagttttgaagattgccgcgccggtagcatcggccgcatggatgatgcgacggtggctgtgaccgccttcgcgggtcagatgaaattcgaatccgccatcttcagtgccggattgatcgtcgcgggtgaacggtacgccctggtcgatcagccactggatggcttcacgactgtgctcgacggtaaagcgcacggcgtcttcatggcacagaccgccaccggcgttcagggtgtcatcaacatgggattcgacagtatcagtgtcatcaagcacggcggcgacgccaccctgggcccagaaggtcgaaccgttggcgagatcgcctttgctcaatacggcaatgcgcaaatgacccggcaaggtcagcgcgagactcaaaccggcagcaccgctgcctatgaccagaacatcatgttggaattgttggctcattacaggattccgctcaaagcgacccgggtcgggggtggcgcaagaccgctggatcggcgagtcaagacagccacacagcccactagtatatagaggggtgggacggcacaatagccgcgccgatatggcattgtgaaactactgtgaaggaaaaaaccgcgtgcttcgtcggaagtttttttcacccttttggggagaacacgactgtatcggcgctgaaacaggatttttctgcccagggttgcccaatgtctgggcggtgcgactataaataattggaacttttgccaaaggcccaagatcaatagtcggtgccagaaacaagggacgtgtcggcttcagtgcggaatctgcggttggattccagcccggcgaaaccgataacaagattattcgcgcagccggtttatcccgcgctgcgtttttcgtgcgtgccaaatcagagcccgcaggaaacttgcctggagggggagaacttttgcgaaaagcccgagtctatgtttgcaagtctggtcgtttagttatgcaagtctccttcgggcttatcgaggagtgttcatgctaacccaggaagaggatcagcagctggtcgagcgcgttcaacgcggcgacaagcgagctttcgatctgttggtgctgaagtatcagcacaagattctcgggttgatcgtgcgttttgtgcacgacacccatgaagcccaggacgtggctcaggaagcctttatcaaggcgtatcgagcacttggaaactttcgcggcgacagtgcgttttatacgtggctgtaccgtattgccattaacacggcgaagaattacctggtttcacgcggccgtcggccgccggatagcgatgtaagttccgaagatgcagagttctacgatggcgatcatggcctcaaggatctcgagtcaccagaacgtgcactgctgcgggatgagatcgaaggcaccgtccatcgaaccatccagcaactgccagaggatttgcgtacggcgttaactttacgtgaattcgatggtctgagttacgaggacattgcgagcgtcatgcaatgtccggtgggtaccgtgcgctcccggattttccgcgctcgggaggccatcgataaagccctgcagccgttgttgcaggaaaactgagacagcggcgatagccaagagaggaacgccatgagtcgtgaagccctgcaggaatcgctgtccgcagtgatggataacgaagcggacgaactggaattgcgtcgagtgattaatgcacttgatgacgtcgaaacccgtgagacctgggctcgttaccagatcgctcgggcagccatgcacaaggatctgctgctgccacgtctggacatcgctgcggcagtatctgctgcactggaagacgaaacggctccggccaaagtatctcgcagcccatggcgcaacctcggtcgcctggctgttgctgcctcggtgactgttgccgttctggccggtgtgcgcctgtacaaccaggacgaaatcgctggtgttgaactggcacagcaatccaatcagcctaccctggccactccacaggtcaaaggcccggctgttctggcaggctatagtgagagttctgaagctaccggccctatggccaatggcgtactgcaaggtcaaccaggctggcacgatcagcgtctgccaggttacctgcgccaacatgctcaacaggctgcactgaaaggcactgaaagcgcgctgccatacgcacgtgctgcaagcctggaaaaccgctaaggaggatcatgcgcgccatacctctactttcgcttctgctaagcggctggttcattgttccagcccacgctgatgaggcccaggactggttgacccgtctgggccaggctgagcagcagcaaagctttcacggcacattcgtttacgagcgtaacggtagtttttctacccataacatctggcatcgcgtccagaatggccaagtccgcgagcgtttactccagctcgacggctcggcgcaggaagtcgtgcgcgttgatggacatactcaatgcgtcagcggcactctgattgccgggctgggggattctccgaactcagccgctcgtcctctcgatccgcaaaagctgaaaaactggtatgaacttgccgtcatcggcaagtcgcgcgtggctgggcgggacgcagtgatcgtatcgctgacgcctcgcgatcagcatcgttacgggtttgagctgcatttggacaagaaaacgggcttgccgctgaagtcgttgctactgaatgacaaagggcagttgctcgaacgcttccagttcaccagtctcgatactgacgaagtcccttcggacaaagatttacaggccgatgccgactgtaaagcgattacgctcgacagcgacaaggcttcggccgtcaagaccgcgcaggtctggcactctgaatggctgccgcccggttttgaattgaccagcagcacctcgcacaaagatccgcaaaccaagacacaggtcaacagcttgctgtatgacgatggtctggcgcggttctcggtattccttgagcctttgaacggtgcaacagtgaccgatacgcggactcaactgggcccgaccgttgccgtttctcgtcgcctgactacccccgacggcgaaatgatggtcacggtggtcggcgaaatcccgattggcaccgccgaacgaattgctctgtcgatgcgtaacactgatggcactgccaccagcaagcagtgagctgattcagtcattaccacttcttcgtcgagacgtagatgaaatgtttgctgagcattttcatttgcaaataccccgaaaattttttataggtcagagcctcacggctctggccttgtttgttgttgccggaacaaaaatgccggtcggtggtttacggtgttccttgctccatatcgcttaaccctgctcgtcgtaacgggagctgtatgtcgataccaagtttgaaatcttatctctccattttcgccactgtgctgttgctcggtcaggtggtccctgctgcgcaagcggccgatctgcctgacttcacccaattggtcgaacaagcttcgccagccgtggtgaacatcagtaccacgcagaaactgccggatcgcaaagtgaaccagcagatgcctgacctggaaggtctgccgccgatgctgcgcgagttcttcgagcgtggcatgccgcctcagcagcgttcgccgggcggtggtggtcgtcagcgtgaagcgcaatcgctgggttcgggtttcatcatttccccagacggttacatcctcaccaacaaccatgtgatcgctgatgctgacgaaatcctcgttcgcttggctgatcgcagcgagatgaaagccaagctgatcggtaccgatccgcgttccgacgtggctctgctgaaaatcgaaggcaaagacctgccagtgctcaagctgggcaaatcccaggatctgaaagccggccagtgggtcgtcgcgatcggttcgccattcggctttgaccatactgtgacccaaggcatcgtcagcgctgttggtcgcagcctgccgaacgaaaactatgtaccattcatccagactgacgtgccgatcaacccgggtaactccggtggcccgctgttcaacctgaacggtgaagtggtcgggatcaactcgcagatctacacccgttccggcggcttcatgggcgtgtcgttcgcgattccgatcgacgtggcgatggatgtttccaatcagctgaaaagcggcggcaaagtcagccgtggctggctgggtgtggtcatccaggaagtgaacaaggatctggccgagtcgttcggtctggataagccagccggtgcgctggttgcgcagattcaggatgacggcccggcagccaagggcggcctgcaagtcggcgacgtgatcctgagcatgaacggtcagccgatcgtcatgtctgctgacctgccgcatctggtcggcgcactcaaggctggcgccaaagccagcctggaagtgattcgtgagggcaagcgcaagaacgtcgatctgaccgttggcgcgatcccggacgaagacaaggagctggatgcactaccgaagtccggcgctgaaagtaccagcaaccgcctcggtgtttcggtgggcgagctgaccgccgagcagaagaaaacctacgacctcaaaggtggtgtggtgatcaaggaggtacaggacggccctgctgccctgatcggtctgcaaccgggtgacgtcatcacgcacctgaacaaccaggccatcggctccagcaaagagttcggtgaaattgccaaggcgctgccgaagaaccgttcggtatcgatgcgtgtcttgcgtcaaggtcgtgccagcttcatcaccttcaaactggctgaataatccagcggtagggtaaaaagaaaccgcctcgaaagaggcggtttttttatgcctgaagcttttatgtcacagcgataaagttagcccatcatgtccttgatcatgcgttcctgctccatcagctcacgctgacgggcatcgatccgcgaggacagcgggaagttgttgccggccttgcgcttggcgaagtccagttgctggatcgcctggcggtaatcgccaaccagcgcgaaatattcggcgcgcgcctgatgcaggccgatgatattacccgacagaccccgcgtctcggcgacctgataccagacgtccggatcatccgggcgtgatttgagcaaaccttccagcgctttctcggcatcgggagcgcgattctgtttgagcaacagatcgacgcgcacctgattcagtggatagttgccggggtactgcgcgagcatccggtccacccgcgattgcgcatccggcaggcgattgttggtgatgtcgagatcgacctgcgccaggttgtagatgatttcgttcggtgaggtcgccagcaattgcttgaggttctcgcgagcttcattcaactgtccgcccttgatctgcgcgatcgcgagtccgtagcgcgccacgtcatttttcgggttttcatccagttgtgcacggaagcgcttggcgcccaggcccggggtttcttcataaatcagctgcacgcgtgcgcgaatcagttgatagcgcttggagtcttcgatgccgcccggtttggcctgttcggcgcggttgcgggtgtcagcaatacgcgattcggtgaccgggtgagtcagcaggaattctggcggcttggcgtcgaaacgatattgacgcatcaagcgttcgaacatggtcggcatcgagcgcgggtcatacccggccttttccagattgaggataccgatgcggtcggcttcctgttcgttctgtcgggagaaggtgcgttgtgactgaatcgccgctgcttgcgtaccggcaatggtcgcgatccctgcatcaccgccaccggctgctgcaatgacgatgccggcgagcagagcggccatcatcggcacctgcatgcgctgcgaagcttcgacgccgcgagcgaagtggcgttgcgacaagtgagccaattcgtgcgccagtaccgaagcgtattcgccctcggtctgcgcattgaggaacaggccgccgttaacgccgaccacaccgcccggcgcagcgaaagcgttgagctgcgggctgttgatcaggatgaattcgaggcgtcggtcagtgacctgactggtttccaccagcttgtaaacgctggattcgacgtagtccttgagctgtgggtcgttgagctgtgaaacctggctgcgcagcatggccagccaggcgcgaccgagctggtattcctgttgcggcgagacaatggcagaactggcgtcgccgagtgacggcagatcgtcggcaaagcctggtgaggcgagcaggcaagcgagcgtcagcagggtagggcgcagaaaagtcatgcacaaagccttagaagacaaagaccttactgtagccggacaccggagctgcgaccagatattctaggcagctcgacgacccgaaccggagtgacgcaatgaccgacgctgtagcccatgacgtggaactggacgccagtggcctcaattgcccgttgccgttgctcaaggcaaaaatggaactcaacaagctcgagagtggcgccgtcctcaaggtgatcgctaccgacgcaggctcgcaacgcgactttcgcacctttgccaagttggccggtcatacgctgctgcgcgaagaagacgaagcaggcgtttaccgttactggttgaaaaaggcctgaacccacagcgtaaaagacctaaggattattgatgttcaaagtgttacgcgactggattcagcgctacttctccgatgaagaagccgtggtgctggcggtgctgctgttcctcgccttcacggcggtgctcaccctcggcggcatgctcgcaccggtgctggctgggatggtgctggcgtacctgatgcaagggctggtggtcacgctggagcgcttgcgtgtgccgggtggtgcggcggtggggctggtgtttgcgctgttcatgggcgtgctgatggtgttcatcgtcgtggtcgtgccgttgctttggcatcaattgatcacgctgttcaatgagctgccgggcatgctcgccaagtggcaatcgttgctgttgctgttgccggagcgctacccgcacctggtctctgacgagcaagtgctgcaagccatcgaggcggcgcgcggcgagattggcaaattcggccaatgggcgctgacgttctcgttgtcgagtctgccgttgctggtcaacatcatgatctatctggtactggtgccgattctggtgttcttcttcctcaaggatcggctgatgattggcgaatgggtgcgcggttatctgccgcgtgaacgcgctctgattacgcgggtcgcgcaggaaatgaaccggcagattgccaactacattcgcggcaaggtcattgaaatcgttatttgtggtggcgtgacctacatcgcttttgtggcgcttggattgaactatgcggcgctgctggcgttgttggtgggcgtgtcggtggtggtgccgtatgtcggtgctgtggtggtgaccgtgccggtgctgttgatcgcattgttccagtggggctggagtgatcagttcatctatctgatggcggtctacgggatcatccagacactggatggcaacgtgttggtgccgttgctgttctcggaggcggtcaacctgcacccggtcgccattatctgcgcggtgctgttgtttggcgggttgtgggggttctggggggtgttcttcgcgattccgctggcgacgctgttcaaggcggtgctggatgcgtggccgcgcaaggagccggcggtggcaccgctgctgtagcggttgatccgaataatgtagagaggctattcgcgagcaggctcgctcccacatttggccaagttgccaatatgaacacggtttagtgtgggagcgagcctgctcgcgaagacgtcagtgaaatagacgcaaaaacatcaggctttattcagatcctgagccgcagccaacaccgcatcaacatgccccggcactttcacgccacgccactcctgacgcagcacaccattcttgtcgattagaaaagtgctgcgatcaacgcccaggtattccttgccatacagcttcttcaatttgatcacgtcgaacaactgacaaacagcttcgtccttgtcactgatcaactcgaacggaaacgcctgcttgcacttgaagttctcgtgggacttcaggctgtcccgcgaaataccgaagatttccgtgttggcagcctggaacgccgcgtactgatcacgaaagccctggccttcggtggtgcagcccggcgtgctgtccttcggatagaagtagatcaccacttgcttgcccttcagggcagacagactgacggtctgcccgctggtggcaggcgcttcgaaatcggcaaccggttggtcgatgacaacggccatgaaagcttccttacattgggttctgtgggcgccaaggctcgatcagtgcgtccaggttcatcgcgtcggagaagtcgaggaactgatcgcgcagccagctgatctgggtaccggccggcagggtcacggtgaacgtggcgttgagcatggtgccgccggtctgtggtgcctgatacgtgtcgcaggtcaggttttccagttcgacgttgtggtccatgaaaaactggcacagctcattgatgatgtccgggcgatacgccgagctgacgtaagccacatatggcaacgcttgtggacgattctccagcggcgcgctgcgcactacgttgacagtgaacgcgtgcttcttggagaggcttggcagactgccttccaggcgggcgagggcgtcccagctgccggaaacctcaagaatcagcgcgctgcactcgccgtggcgggtcaggcgtgaagtgactacggcgcagcgattttcatggctggcgcggcacaggacgttagtcagctccatggggttggcgccgagggcactgatgacaaggaattgttcgcgaactgtgggggtggacatgcagcattcctaaagcgatgagcggtcggtaggttacggacgctggcggccggggcctgcctgttctggctgtccattgcgatagacccgccaagcgctcgcggctcgctccactatagcgggagcgcgtcgatgcgacgcaggaacggggtctgggaggccgaaaagggaggctggaacccgacgtacaagctgatcggtaccgatcaaagtctgaagggtagcgaaaagcggcgccaaggggaatggcggcagcgcagtacttcgcttgtgcaagcatcttggcgccagtaccattaccgctctctttttccggcaggagcggtttcatgattgcgggcagtatggtggcactggtcactcccatggatgcacaagggcgtcttgactgggacagcctcagcaaactcgtggacttccatctcaagaacggcacccatgccattgtcgcagtcggtactaccggcgagtcggcaacccttgatgtagaagaacacatcgccgtcatcaaagccgtggtcaaacaggttggcgggcgcatcccggtcatcgccggtactggcgccaactcgacccgcgaagccgtcgagctgacccgcaacgccaaagaagccggtgccgatgcctgcctgctggtggttccgtactacaacaagccgactcaggaaggcttgtaccagcacttcaagcacatcgctgaagcggtcgacattccacagattctctacaacgttccaggccgcacgtcgtgcgacatgcaggccgagaccgtgattcgcctgtccacggtgccgaacatcatcggcatcaaggaagccactggcgacctgaagcgcgccaaagcgatcatcgatggtgtgagcaaggatttcatcgtgttgtccggcgatgatccgaccgccgttgaactgatcctgctgggcggcaaaggcaacatctccgtgactgccaacgtcgccccgcgcgaaatggccgacctgtgcgaggccgctctcaagggcgacgccgacaccgcacgggcaatcaacgaaaaactgatgccactgcataaagacctgttcatcgaagccaacccgattccggtgaagtgggctttggttgaaatgggcctgatgcacgaaggcatccgcctgccgctgacctggctgagcacaccttgtcatgaaacgctgcgctcggccctgcgccagtgcagcgtcctggtttaattgaggaagtacaacgcatgaagcgaatggccggactttccgcacttgccttgattatctccagcaccagtggctgcggatgggtctggggcccggaaggttatttccgtgaccgcggtagcgattacctggaagcgcaacagactgcaccgatgcaactgccaccggatgtcagcacgtccaaacgtctggatccgctgctgccgatcccgcgtaacgtcgctgatgacaccgccaagggcgaatacattgtgccgcgtcctcagccgctgtcggccgttgccgatgccagcgattactcgctgcagaagagtggtgattcgcgttgggtcgtggcccagcatccaccggccgaagtctggccagtggccgtgcagttcttccaggacaacggtttccgtctggacgaacagcgcccgcagaccggcgaattcaccaccacctggcagcattccgacgaactgtccgcgtccatggccaagcgcctgagcgcagccggtatcgccagcgacagcgaaacccgcgtgcgtgtgcgtatcgagccaggcgtgcagcgcaacaccagtgaaatctacgtggtcagcgccgagcgtcctgccggcagcaccgccgatgtcgatttcaccaaccgttcggtcaacactggcctggacgcagccctggtcgacgacatgctcgcgagcatgagccgaatctccgagaagggcggttcggtgtcgatgctggcctcgcgtgatttcgataccccgagccgtgtcagcctcagcgaagacggcagcggcaacccggtgttgaacgtcggtaccgatctggaccgtgcctggtcgagcgttggccgtgcactggaacaaggcgaatggcgcgttgaagacatcaaccgcagcctgggcctgtactacatcaacctggccgaaaaagccgagaagaaagacgacaagcctggtttcttcagcagcctgttcggcagtgcgccgaccaaggaagaagttgaatcccgtgctgagcgttatcaggttcgcctgagcaaggttggcgagaacattcaggtcaccgtcgagaaaaacatcaacaccgtcgcgccggctgaagtggcgcgcaaagtgctgagcgtgattcaggacaacctgggctgatcaaccatgcgttttgccgttctcggcagcggtagccaagggaacggcacgctgatcgccagtgctgatacgtatgtgctggtggattgtggtttttccctgcgggaaaccgaaaagcgcctgttgcgcctgggtgtgaacccggcgcaattgagcgcgatactcgtaacccacgaacatgccgaccacgtgcatggcgtgggtttgctgtctcggcgctacaatctaccggtctacctcagtcgcggcactctgcgcgggatgcgcaaaccgattgaacccgcaggctttctggccggcggcgagcaactgcagatcggtgctctgaacgtcggggtcattgccgtggcccatgatgcgcaggaaccgactcagtatgtcttcagtgatcaagagcagcggcgcttcggcctgctgaccgacctgggttcttactgcgagcgggtgctggacggttatcgggacctcgatgcgttgatgatcgagtccaaccattgtcgtgacatgctggcccgtgggcactacccgtactttctcaagcagcgggtgggcggcgagctgggacatttgaacaaccatcaggcggcattcctggtgtccgagttgggctggcagggcttgcaacaccttgtcctggctcatctgagcagcaagaacaacatgccgcagctggcccggcaatgttttgtcgacaccctcgggtgcgacccggactggctgcaactggccgatcaagattcagggctcgactggcgccacatcgcctagcccacctacttagcaagcggagcccatcatggaaaaacgtgaagaactctaccgcggcaaagccaaatcggtttacaagaccgacgacgctgaccgcttgatcctgctgtttcgcaacgacacctcggcgttcgacggcaagcgcatcgagcagctcgaccgcaaaggcatggtcaacaacaagttcaacgccttcatcatgcagaaactcgaagcggccggcgtaccgacccaattcgacaaactgctggccgacaacgaagtcctggtcaagaagctcgacatgatcccggtcgagtgcgtcgtgcgtaactacgccgccggtagcctggtcaagcgtctgggcgtcgaagaaggtctgaagctcaacccctacaccttcgagctgttcctgaaagacgacgccaagggcgacccgttcatcaacgaatcccacgtcgtggcattcggttggggcaccgccgagcaactggttcgcatgaaagaactgtcgctcaaggtcaacgaagtcctgaccaagctgttcgacgatgctggcttgctgctggtcgacttcaagcttgaattcggggtgttcagcgacggttccatcgtcctcggcgacgagttcagcccggacggctgccgtctgtgggacaaggacaccaagaagaagatggacaaagaccgcttccgccagggcctcggtgacgttatcgaagcctacgaagaagtcgccaatcgtctgggcgtaccgctttaatcgacgcaagcatctgatagcacggagaaattttcgaaagagggtttgctttcggtaaaagtgttgttatgatgcgcgccgttggagagatgccagagtggccgaatgggacggattcgaaatccgttgtaccttcaccggtacctagggttcgaatccctatctctccgccattacatagaaaaagccccgtagctgagaagctacggggctttttcgtttctgggattccatgagtttttagagttcgaaaggcatgtgccagccagccatctcgatcctgacctgacacaagcaaaagccccacgggcctttagccgtggggcttcttcatttgcgcaaggctacatcaccccgcgccctagccattcacggctgcgagtgccccaacttcagtttgatcaattcatacacatccttatgtgtcgagtcatgcagcgacttgtccatgcaagcggtagccaggaagtttttcacttcgtccttggcgtgcgggtagaggctggcgacataatcagcttcgtgttcttgcgtgcagttgaagtgcttgtcgtctttcgctttgtctctcgccatttctgtggctcctttttagttcaattgatgcggcgaaacagggctgaatcaccccatacgtcgatgagcgtaggcgcgcagaaatggctcgtcagtcgttcgctgaaaaaaaggacgcggctgtaggacgcagctccgcatcggctcacgcgattaaatttccttcaccggggtatcgccgtgcacggctctgatcaactcgatcacatgcatgcaatccgccttgttcacatatgactcgccactggcgatggtctcgtgattgcccgcgcgcagcctccatcgccattgccccttgccagtgctgggggtgcctctggattgcctgtaaatctcgaaatacattcagttcgctccatgcgatttattagtgcgaccgcctgtttggcgcatcgacgcaagcctagcgcaggcggtttttttggctatcggacatttgtatccaatcgttggcaattgtttccgagagccgcgagctagagcgcagcaataggcctctggattggccaatatgacgccgcctgacgcttgcaacaccggcgacgctactgcttaatacgggacggctcatggcatcggaaatagttcgatgaccgaacaaacactataaaaagagcactcctttgactgagcacggaacgcaacaggccgggcaggtgacgttatcgctggtggtccccgtttttaacgaagaagacagcctgaaaacgtttctgctgcgcatcgatgaagtctttcgaaagcagacgctgatcggtcttgagctggtattcgtcaacgacggcagcaccgatgccacgcttgagcttttgcttgagcatcagcagcaggatgcgcgactgcgtatcgtcgatctgagccgcaatttcggtaaagaggcggcgctctccgccggtttgcagatggcgaccgggcagatcgtcgtgccgatcgatgcggatctgcaggatccgccggaagtcatcctgcagatgatcgaccgctggcgcgaaggctatgaagtcgtactcggccaccgcgtcagccgccgcagcgacacttgggccaaacagaagtccgcccactggttctatcgcctgcacaacagaattgccgaacagcctctgccggaaaatgtcggcgacttccgcctgatggatcgctgcgtggtcgatgcgttgctgaccttgcccgaatcccggcgcttcatgaaaggcctgtttgcctgggtcggctttcgcaccactcatgtcgattacgagcgccccgagcgcgtggccgggcagagtaaattcaacggctggcggctgtggaacttcgctttggaaggcatcaccagtttcagtactgaaccgctgcgagtatggacgtatgtgggcgcgctggtctcgctggtgtcgtttgcctttgcgattttcattgtcgtacgcacgttggtctcgggcatcgatttgcccggttacgcctcattgatggtcgccgtgacgtttctcggaggtttgcaattgatcggcatcggagtgctcggcgaatacctgggccgtacttacattgaagcgaaacgccgaccggtttttctggtacgtcgcgtctacgacccgaaggactgaaacatggatctcaaggaaaccgacatcctcggcgacagcatcaacgagcattggtattactgctccaaagcggcggcaaccacgcgtctgctggggagtgtgccgatcaggcgaattctcgacgtgggtgccggctccgggtttttctcccaccatctgctgactcataccgacgcgcaggaggcatggtgcgtcgatatcagctatccggccgattcaagcgcgacaaccgctggcaaaccggtgcactaccgccgcgggatagaaacaatagatgccgatctggtgctgctgatggacgtgctggagcatgttgacgatgacctcggcctactcaagatgtacgtcgataaagtgccttccggcagccgttttctgatgacggtgccggcgttccagttcctctggagcgggcatgacgacttccttgaacacaagcgccgctacaccttggcgcaattcgaaacactggcccgcgctgccggtctgacggtgcaacgcggcgcttattattttggtgcggtgttcccgatcgcagcggcgttacggttgttgccacagggctcgcaaacgcaagcgccgcgctcgcaactcaagcgtcatcacccgctggtgaaccgcacactgaaaaccttgtgccgccttgaactgccgttgatgggcaggaaccgtctggccggtttgagtgtgttcgtgctggcgcaaaaaccgtgacctcaaccgaaaaatcagtgctgatccagcgcggtttgcgctttgccgtgaccggtttgttcgtcacggctttgcacgcgctggtcgcggtgctgttcatcaacttcatcagtccgcagccaccgattgccaacggcgtggcgttcgccgtggcgaccgtcgtgtcctatctgatcaataccacctggagtttctcggctcggttgcatggcaaaaccttgctgcgttttctgctggtgtcgacgtgcggctttctattggcaatgtttgttgcctgggcggcccagatggccggattgaattacctgttggggattgtcgcggtggcactgactatcccggccttcacctttgtcttgcataatttctggacgtatcgatgaaggatttcacaaggcgcctggctgtcactcttttgccgttgatgatcggcgtattggctttctttatcgtcgttggccctcgagcgctcgacccgcagaacattgcctggctggggcagggcgatccggcgacgcactatctgggatgggcgtttttccgtcaggcgccgtggacgtttccggtcggcctgaacccgacatacggacttgaactgagcaacggcctgatcttttccgactccaatccgctgctggcattgttgttcaagccacttgctgggttacttccgcagacatttcagtatttcggaatctggttcctcgcctgttttgtcctgcaagcgtggtttggctggaaattattggggcttatcacctccaacgtcgctttgcgggcattgggttgtgcacttttcctgtttgctccgccgatgatcatccgcatgccgacacatttgtcgctggccggacacttcctgattctggccgccttatacctggccttgcgccctgaggaccagcggcgacggttggcctggggggctttgctggcgtgcaccgcgttgattcatgcgtatttcctggccatggtcgcgctgctttggctggccgatctgatcacccgtcatttcaaagccagaatcagcttgcgcgaagcaggcggtgaactgattttgttgtttgctctggtgagtttttgctgctggcaagcggggtatttttccgtcaatggttccgatgcgatctccgacggattcggcttgtaccgagccaatgtgttgacactgttcagccccaatcattggtcatacatcctcaaggatctacccggcggtctgggggatacggaagggttcagttatctcggactggggctgttattgctggccgtctgtgggtgggtcgggtggctgcaggggcgaaccgggttggagcggtcattgcgtcgacactggctactgctgatcgcgcttgccgggctgacggtatttgcggtttccaacaacattgcctttgctggcgcgaatttcagctatcccttaccggaaaagataatagccatcgccaatatctttcgagcctcgggacgaatgttctggccggtttattatgcgttcattctgttgatcatttttctggtggtacgcgccaataaaccgcgtgtggcaaccttgctgatggctgtggcgctgacggttcaagtcgcggatacgcacagcggctggtctttggtgcgcaagcagttgatggtcgagtcaagcacccaatggaagacaccttttgtcgacccgttctggaaaaatgctgcggcgcattatcagaagatccgttggatccttcctcagaacctgtcgccggagtggatgaatgtcgccgcattcgctgcaacacatgggctggcgaccgatgctgtctatctgggacggatgggcaaggatcagtgggagattgctgatgagcacagccgcacgatgctggcttcgggtcaatatgatgcggattcgttgtacctgctcggtgatcgggcgttgctgcaggcggtttcgaccgtcaataccgaagcggatctgttcacccgtatcgacggattcacagtgctggcgccgggctggaaaaattgccgtgaatgcgtgcaggtgcccgtcgaccagacgccacaacagctggtgcctgagttcgtctctggagaaacagcgcagttcagctatggcgctgtgggcaaggactatctcgcgcgaggctggtcggatgctgaaacctggggcgtctggtccagcggtgccgaagcggaaatggccatgcgagtgaacgattcggcccgcaccctgcatcttgagaccacggcgttcctggcgccggggcatttgcgtcagcgcgtggtgatcaagctcaacggcatcgaagcgctggcgaccactctggacaagccggaaggtaacagtcttgaattgcagctcactccggctgtccgccaacgcatcacgcaagagggtttgctgcgtgtgcaactgcagttcgccgatgcgatcagccctgagcagttgggcgtcggccaggatcgccggcaactcgcgatcggcctgaaggcaatgtcgatcaactgagccgtgtccgcatagacgttgtcggcggacctttctacactgcccttcagtcaggggatcggggggcaatggatgaaccgcaatgaattacgcaaggccgacatcaacctgatggtggtgttcgagaccttgatgctagagcgcaacgtgacccgggcggcggagaagttgtttctcggccagccgaccatcagttcggcgctcaaccgcttgcgcaccatgctcaacgatccgctgttcatccgcgtcggccatcgcatggagccgaccgcccgggccgaagatatcttccgccacctcaaacccgcgctggactccctgtcagtggcgctgagcctgacccgcgatttcgatccagccgtcagcaccatgacttttcgcatcggtctgtccgatgacgtcgagttcggcttgctgccgccgctgttgcgcgccttgcgccaagaagcgccaaacgtggtgtttgtggtgcagcatgtcgattactggcggattcccgatttgctcgccgctggtgacattactgtcggcatcagccagacccgtggcctgccggccaatgccaaacgcaaactgctgcggcacattcagccgagcatcctgcgcgcggatgcgtccgatacaccgttgacccttgatgaatattgcgcacggccacacgtgctggtttcgcacacggcgaatgtcagcggtttcgctgacgagtggctggcggagttggggcgcacccgccaggttgtcctgtcagtcccgcaatacagcgcattgccggcgctgctggctggcactgacttgatcgccagcctgccggattacaccgcagcggccatggcgacttccgggttgctgttcaaggaaccgtttccgttcaagacgccgacgctggacttgtcgatggtctggctcagtcatgtcgatagcgatccggccgagcgttggttgcgcgcaaggctggagcagttcatgagcgaacgaccggtgaccccgtcctgatcaacatcccctgtaggagctgcggcacgctgcgatcttttaatctttgaatctcaagatcaaaagatcgcagcctcgtttcactcgacagctcctacggggatatgcgctgagccgcttgtggtatatgtacgaactttccgctgactgactggagcctcccgatgccacacctgcacatggaatacaccgccaacctgccgcagttgaacgccgatgttgcgttgatccggctcaacaatacattggtgggatccggtcagtttgcagcggagttcgatatcaaaagccgcgcagtcaaggtcgagaccttcaaggttggcaccgccatgagcgaacgcgccttcatttacgtgaagctggcgctgctcagcgggcgttcgccggagaccaaaaagcaactgtcgcaaagcttgctggcggtgttgcaggatctgtgcgagtggccggccggggtggaagtgcagttgtgtgtcgaattggtcgacattgatcgcgagtcctacagcaaagccgctatcagcgtgtaggactcaggcgtcttgcagttcgctgcagaccttgatcacctgctcgcgcagccagacgttggcgctgtcctgatcggcgttctggctccattgcatgtcgagtgtgaaccccggcaagccgttcggcgcctcacaatggttaaacaccgcttcgttggtcagtagacgctggatgcgccgggggagggtgaggatgaagtcggtgccggtgatcattttcaacgccgcgctgtagctgttcgaacgcgcgacgatctggcgcttctgcgcctgtcgcgccaaccagccatcgaccatgttggtggtcgatgtccacggcgtcgggaacacatgtcggcgttcggtgaacgcctgcaggctcaggcgcggctccagtggggtggcgcgcttgtcgaacacacagaccagatcgtcctcaagcagcatgcgtgacttgagatcggtgtgattgcgatggaagttcggcccgaagctgatcaccagatcaaggctgccatcgcgcaactcgtcggccggcacgtcggtttcaaacttgtgcatgttgaccatcaccggcaaatcgtcgaagtcgaaacgtttcaacagacgcggcaagatcaattgctcgaagtattccggcgcacagatattgaacgtgacagcttgtagcgtcggatcgaaagccggcgcgccggcgtggcacaggttgatgctctcgaggatcttctgaacatggccatacatgctgctggccttgtaagtggggcgcatgccggtacgtgtattgatgaacaactcatcttcaaaactggtgcgcagtttcttcaggcagtaactgacggtcgactggctgacaaatagcgtttccgacacatcggtgacgctgctttgttcatacacggcgataaacaccatgagatcctgcatgtcgagctttcgtagcaagttactgttcagcatccgttctgtctcgctgtgctccttgcgccgaatccgcgcaaacgtgtgcgaatgatcctaacggaacgatggtgccaggacaaagccctgtaggacatttcacggacagttgtgggacagaaagttttagcaacacgacgtctgccttcaaagcgctaaaacatggccagaagcctccagtcagatcagccaaagtgtcgcgcgtaatgtcggggatcgaagcgcctcaccatcagtagcatgatcaccatcaccgccgtcagcgaccaccacgcccattcgaaactgcccagttggtcgcgaacaatcccggccatcaacggcgagaggccggcaatcatatagccgatgccttgcacgaaagccgtcaggccccccgcacgctgcgggttatcgagatgatcgagcgagacgatcaggctcattggaaacagcccgccaatgcctagacccaacaagcatggccagaagaggctgaggtgttgcgggctcagaatcagcccacagaaaccggcgatgatcaggccgagtagcaccgtcagtacggagcgccggtcgcggctgcgattggcgatggcgggcaccaccagaccggaaatcacctccatggcagtcagaaaacctaacaacagcccggcgctttgttcgctccagcctttttccacgtagtacggcgcgagccaggcgagcacacaggtgtaggacgccgtgcccaatccgaagaagatcgcgagtaaccaggcgcgggaattgttgtagaaggaatcttttcttgtcgttgttgcagcagttgccgacagactgcggcgttgcaaccaccagaacaccagcgcaagcgacgcgagcaccgcccagatggccagaccgctgcgccaatttccggttacccccatcaccatcggagcgaacgacgcggcaagcgctgcgccgcccatgatcgacgtgacatacagccccatgcacaccgccatgtgattcgggaaacgcgatttgatcagcgccggcatcaacgcctgaatcagcgcgatgcctattccggccagcaccgcgctgacaatcagctcggcagcagagtcgatgaacagccgcgataacgtcgccaatccgatgaccagcagcgacagcatgaccgtgcgctgttcgcccagtcgccgactgatgccaatgccaaaaaacatcgccagtcccatggtcatcaccggcagcatcgtcagcagtgaagcgaggctgaaactcaaggggatatcgtcgcgaatcgccgacagcagcggcccgactgccgccatcgaagggcgcaggttgagtgcgactagaacgatgacaagcatcagccagacggcagggcgggcggtggcgcgggagttttccatcttcagacctttgagcgaggggctggagattaggcgcggatctacttgtggcgggcaaaccggaaaatccagagcagtatttaaaaactcgataacccaacaagacacctgtgggagcgagcctgctcgcgaaagcggcgtatcagccaccgcaaatatcgactgacctgacgctttcgcgagcaggctcgctcccacagaggaaattttctgaataaaagctgaaccattctcaaatacttccaaagtttcacggagttcccgcaagccaactaatcgttggcgtctttttcacaaaaaattgatgattgcctgcctaaagtttgtcatgccttagttaatgattttttcacaaacgaaattttcataattacccaaggttgttctcttcaggaattgcccttctctatgttgaagttaaaagccgtgcgcccggaatgggtgacgttgattgccagtgcctttcttttgaccggcttcaatgccgtgctctggcagcacctgtttgacatcaccgcagccgatggcaacggcgtcgccatgcgcgtggcttttggggtgatgatcttcgcggcttttaacattgtgctgacgtttctggcgttccgtccgctgcttaaaccggtcttgatgctgatattcatgatcagcgccggcgtggcttatttcatgagccaatatggcgtgatgattgatgcgggcatgtttcgtaactttgccgaaaccaatgcgacggaagtccgcgatctgctgtcgttaaagttgtttgcttatattttattgttaggtgttttgccgtcgttgttgctttggaagatgccggtcaactaccgtcgctggcaccgcgagttgttcagtaaagttatcgtgagtgtggcgtcggcagcggtgatgggtggcgtggcattggctaactatcagggcctgtcttcattgtttcgcaatcaccacgaaattcgtttgatgttggtgccgagcaattacatcggcgcctcggtcggttatctgcgtgagcaggtggtctcggcgcagcaacccttcgtcaagatcggtgaagacgcacagcgcaatgccgctgtgaaacttcagccgcgcaaatccctgactgtattggtggtgggcgaaagtgcccgtgccgagaacttcggcatcctcggttacgaccgcgataccacgcccaaactcgacaaggaagcggggctgattgcctttaccgatgtgcactcctgcggcactgaaacggccgtatcggtgccgtgcatgttctccaacatgggccgcaaggattacgacgccagcaaggcgaagaacgaagaaggcctgctggatgtgctcaaacgtgcgggtattgacgtgatctggcgtgacaaccagtccggctgtaaaggcacctgtgatcgtgtgacggttcaggatgtcagcaacttgaaggatccgacactgtgcgccaacagcgaatgccgcgacgagatcctcttgcagggcctgcaaagctttatcgatcacctggacaaggacaccgttctggttctgcaccagatgggcagtcacggcccggaatatttcaagcgctatcccaaggagtacgagcacttcacgccggtttgtgaaagtaatgcactgaataattgcagccgcgaaagtatcgtcaacggttacgacaacacgctggtctataccgaccaagtgctgtcgagcctgatcgatgtcttgcgcagcaatcaggacaaagtcgataccgccatgctgtacctgtcggatcacggcgaatcgctgggtgagtacaacctgttcctgcatggcacgccttatatgctggcgccggagcaacagaaacacgtagcgatgctggcatggttctctgacaactatcaaaaggcttactcagtcgatacccattgcctgcaaatgagtcgcgacaagccgctgagtcaggacaacctgttccactcgatgctcggtctgctggaagtgaagagctcggtgtatcagccgggtctggacatgttcgccggctgccgtggcgccgtgatcgacggcgtcttggccaaagactgaccgtcaccctcctacagagacgggcacatctgtttgctttgtcagactattcttgccaattggcaggacatttcgttacagctcttgcccttcgcaggcgcgtaaatcgccaacggcgatatatactgcgcgccattcttcaagggagagccgtgtggccatcgatattcactggattcgcgacaacgatagcctcgcgcagttttgcgccgagtggcagcagttgcctttcgttgccctcgacaccgaattcatgcgggtcgacaccttctacccgattgccggcctgctgcaggtcggcgacggcaagcgcgcttacctgatcgatccgctgaccatcaacgcctggcagccattggccgcgttgctggaaaacccggcggtgctcaaagtcctgcacgcctgcagcgaagacctcgaagtgctgttgcgcctgaccggcagcttgccggcgccgctgtttgatacgcaactggccgccgcctatctcaacctcggtttttcgatgggttattcgcggctggtacaaaacgtactcggcatcgaactgccgaaaggcgaaacccgttccgactggttgcagcggccgttgtccgagacgcaaatcagctacgccgctgaagatgccgtgcatctggcggaagttttcgtacaactgcgtccgaaactgtccgacgacaaatttgcctgggtgctggaggacggcgccgaactggtcgccaacctgcgccgcgaaaccgatccgtacgaggtttaccgcgaggccaaactggcgtggaaactctctcgtgcgcaactcgccgtcctgcgtgaactgtgcgcctggcgtgaaaccgaagcacgcgcccgtgatctgccgcgcaaccgtatcgtccgcgaacattcgctgtggccgttggcgcgcacgcaaccggacaacattgctgcactgggcaaaatcgaagacatgcacccgcgtaccgtgcgtcaggacggccagtttctgcttgatctgatcaagcgctctggcagtgtggggcctgatcaatggccgcctgccgtgccggagccattgccgatcgaagccgctgcgttgatcaaacaactgcgcgccctcggtcaggccgaagctgagcgactcgacatcgcgccggagctgatgctgcgcaagaaaaccctcgaagccctggtcaaaagcggctaccccgagggtccttaccaattgcctgagtcgttgcgtggctggcgccgcgaactcatgggtcagaagctgctcgacagcctggccaccgccggagaacagccttgaaacgtatttgctccatctaccaaagctccaagcgcagcggcatgtacctttacgtgctcaaaagtgacgcgctggaacgtgtgccggaagcgctgatgctggccttcggcaaaccgaaacattcgttcgatctggtgctttcgcccgagcgcaaactggccagcgaagacatcgtcgtggtcctcgaaaacctcgacaagcagggttatcacctgcaaatgccgcccgccgaggacgagtacatcgaacacttgcccgaagagttgctgcgacgcaacgatccggtctgatctgcaaggccctgttctgggccttggttaaccctggaactgtttttaccgcgatggccgccctgaatccggtggccgtctgcacggtttgcgaaaggtttgaagatgcgcgttctgattgctgaacacgaccacgcgatatacgcccgactgctgcgtcaggcagtgccggaactcgaagtgctgaccagtggcgactctgccgaactggcccgtcaggcggccgactgcccagtgtggctggggcagccggatctactggcgaccctgctgcgtcagggccatcaaccgcaatggctgcagtcgacctgggccggcatcacgccgctgctcgccgatggcttgcgccgtgattatcgcttgacccgggcggtggggatttttggtcaggtcatggctgaatacgtcctcacttacatccttggccatgagcgcgaagtactggcgcggctggtcagtcaggtcgagcgtaaatgggacaaccgcagcggccagagtctggtcgggcgcaaagtgctgatcgtcggtacgggcgacatcggccagagcgtggcgcaattcctgcgaccgttcggcgttgagctgtacggcatcgccagcagtgcccgcgagcaggcgccgtttgtcgaggtcggttcgatggcggatctgccacgactggtcggcgaggtggattacgtggtcaatctgctgccgaacaccgagcacacccacgatatctacgacgcagcgctgttcaagcaattcaaaccgaccgggttgttcatcaatgccgggcgcggtgtcgcggtggtcgatgcggatctggtagacgcgctgaaagaagggcatctggccggcgcggtgatcgatgtctgccgtcaggaaccactgccgcaacggcatccgttctggacggcgtggggcttgctgctgaccgggcacagctcggcgccgacgtcaccggcgttgatggtgcagctgtttgtcgagaacctgaaggcgtatcaggcgggtgaagcgttgcgcggggaagtggatttcaatcgcggctactgacacggcggtaaaaaatgtaggagtgagcctgctcgcgatagcggtgtatcagacagcattaatgttgactgacacggcctcatcgcgagcaggctcactcctacagtggttttgcgctgtggcttagagggtgaagtcgccttcggccgccagctcgttcagcggacggcgcgggctcggctcttcacgggcttgcaggtattcagccagcgttgccttgtcgcccagtttgccaacggccacggcagcatgcagcgcataaccttctggaatgttcagctccttgcgggtcagttcctgatcgaaaccagccataccgtgagtgtgccagccgctgatgctcgcctgcagcgccagatggccccatgccgaaccggtatcaaacgtgtgccacagcgctggagtttcttcgctggcacccggtgcggtgaaggtggttttcgaaatcacgatcaccagcgccgacgcatgctgcgcccagctgcggttgaattcattgagcagacccaggtaacgctgccagttcggcgtatcgcgacgcgcataaaggaaacgccatggctgcgagttgtacgccgacggtgcccagcgtgcggcttcgaagaaactcagcaaggtttcttcggcgatcgcttcaccggtgaaggcgcgtggtgaccagcggtcggtgaattgcgggtgaatggcgtaatcggcaacgcgagggttggcactcatcgagagattccttgctaagtttgagtcatgaattcgaggcaaaaccctacttggcggcgattgggctgacaagtgcgatttaccggcagtcgccaacgcttggcccacaaggccttgggcactagactggcggccttttcactacctgatgttgatgcttgagccatggtcgccaaagtcgaaccgttctggaaacgcaaaaccctcgatcaactcgatctggaggagtgggaatctctgtgcgacggttgtggtctgtgctgcctgcaaaaacttgaggatgaagaagacaatagcgtctattacacgcgcatcgcctgcaaactgcttgatctgaaaacctgtcagtgcagcgattacccgaaccgcatcaagtttgtcccggactgcatccagctcaccccgggccaggccgaagaattcaagtggctgccgccgacctgcggttatcgcctggtcagcgaaggcaaagacctgccaccgtggcaccacctggtgagcggtgaccgcgatgcagtgcatcacgagcggatctcccaatccgggcgcatgctcgccgagggcagcgtgccggaagatgactgggaagatcacctgattttccgcgcgggctgaatcaaccgcagagttcaagtttcacaaaggagtgtgtatggctgtgggattgcagcgatcgctgctggttgcactgctggcgctgagcgcaccggtgtgggcagcgaagaaagtggacctggattaccacgtgcgcctgttgccgcagagcgatcaggctgaagtgcgcctgaccctcgccaagggcgaagcggtgcgcagtctcgacttcgaccttggcgacggcagccattacagcgacttcaaggctgacggccagtggctgctgagcccgggcaaacaggcgcgcggggtctggcgccccgccagcgaaaagtccagcctgacataccgtgtacgcatcagccacggccgcaagaacggcagcttcgacacgcgcatgaccccgacctgggcgttgatgcgtggcgacgaactggtgccgccggccaaactcgatcagcaggacggcatcgaactggtcgcgcgtctgcaattcgaattgcccgagggctggaagagtatcgagaccgcttggccacgcatcggcaagaacaaattccgcatcgataatccatcacgcctgttcgaccgcccgaccggctggatgcttgccggccatctcggcagccgccgcacacggctgggcgaaaccgaagtcacagtggcttcgccacaagggcagggcatgcgccgcatggatgtgctgaccttgctgacgttcgtctggccgcaggtgcaggccgtttatccacgccatccggccaagctattgatcgtgggggccaacgatccgatgtggcgcggcagtctcggcgcgcatgaatcgatttatctgaacacacgattgccgctggtcagcgagagcggcagcagtgcgttggtgcgcgagttggcgcaggtgtttgggcggatcaacgatgagcagcgcagcgcctggatcagcgaggggtttgccgagtattacgccattgaattggtacgccgtgccggtggcatgagcgatgagcgttatcaggcgttgcaggcgaaactggccaaggacagccagaaggtcacgaccctgcgcggcgcacagatcagcccggcgcaggtcgcaaaagcagtaattttgttgcaggagctggatcgcgagattcgcttgcagacgcgcaacaagcgttcgctggatgatgtgttgcgtggggcgatgcatctgggcacggtgagtaccaaggcgtttgtgcaactggccgagagtgttctgggcgagtcctccaaagtccttgataccgcgttgctacagtaaagatcaaaagatcgcagccttcggcagctcctgcttgtggaatgcgttttccctgtaggagctgccgaaggctgcgatcttttgctttaagccatcaaaccccggctttcggcgacttcaccgaatcattgccggtcaccgtagcggtactggtcgccgcctcggcattcgccttcagcttgctcaactcttccccggcccgctcgatcttcgcgcgcacgttgttcatgtcctgacgactcttctcgatcaggcttttcatcgagctgtgcccggtaatcccgcgcgccatggccacgccgccaatcgccacctgaatcaaaccaaacacaccgccacggcgcaggcctttgccgaccatgatcacgccgcccgcgagtgagccgatgcgctcccagccttcgacgttctgctcggaatggctctggaacggggtggattcgatgcgttcgacacgtttgagctcggtcatgatctttctccaggcaatgagtaatcgataaacaagctgactgccggagcggtcagctcgttccatcgaatatgcgctgtttcagcggaatttcggcccggagcgggtgttcaggcccttggccatgcggtcgtagagcacgacgttgaccgtggcggcgaggttcatgcagccggtggtcgggatatacacgacgtcttcgcaccagtcgcggatctctttatccagcgaaccgtcttcgggaccgaagatgtacagggcgcgatccgggtgggtgtattccggcaacgggcgggcgccctcgaccagttccacggcgaccggtacgcagttgagcgggagaatctttttcagatcgtcgataccgatcagcgggatgtcatagtgcacgcgtttggtgtcggtgacgaagtcggcggcgcgttcatagcgcttgccggtgtagaacactgacgccacgccatagcagcctgcggcgcgcatcaccgaaccgacgttctccggtgatttggggttatacaaaccaatgcagctgtaccgtttgtctgccacgagcggggtgccttcgggaaaaagagcgcgattatacggggattgggggagggcggcaccgctcgttcccacgctctgcgtgggaacgtctcttcggacgctctgcgttcggctttgcaagggacgcggagcgtcccgggctgcattcccacgcagagcgtgggaacgatcatgactggcttattcttcttttttcatcaacccggccagtgcggcaaacgggttatgcgtcgccttggcaatcttcggcgtgctcagcgagccttcgctgaaatactgctgatcggtataacgcgaatgttcgttatcgtggcaatacaggcacaacaattcccagttcgagccgtcctgcgggttgttgtcgtggttgtgatcgcggtgatgcacggtcagttcgctcaggcgcttgccggaaaactcacgggtgcagcggccacagacgtgcgggtacatcttcagggccttgtcgcggtagcccatttccttgtcgcgctggttgtcggcgaggatgcgatccagcttcgacgtgttggtgggggtggacgaactcatgggttcacctttgtaaaagactaatgacggttatgtgcagagtttagctcagcccttgagcttctcggcaatccagatcgtgtggcgcgtgcccttgttgccatgggcaaagacctggacttcttcggccttgaaaccggccttcttcaatttgtcggaaaacagccgatcagcactggccgaccacacggcgagcacgcctttcgggcgcagggccttggcgcacgcgttcagaccggcggccgagtacaaccagctattggccttctgggtcaggccttcagggccgttgtcgacgtcgagcatgatcgcgtcgaagccgttcggctcgctttgcagcaccttggccacgtcttcctgacggatcaccgtgcgtggatcaagcaacgggcgaccggatttttccccgagcgggccacggttccactcgaccacgccgggcaccagctcagcgaccacaacttcagcgctcttgcccaggtgcttgagcgccgaggcgagggtgaagcccatgcccaaaccgccgatcagcacccgcgagtccggccggccagcgaccttgcggcacggaatttccgccaatgcgtcttcggaaccgtgcatgcgcgtgttcatcaattgtccgccgtcgccgccctggatcttgatgacaaaatcctcgccatactcgaacaggcacagggcaccgccgctttcagggatcggggtagtgtcgagcagaacgaaacgtttcatggaaatctctacaagggggaaggcaagcaggcccgttgggagtagcctgagcgcagactagaggccaaacggagcccttgatgaagcgcaccattctaacggtcattgccctggccgtgctctcgattactgcagtgcaggcgcagcagacgattccgcttagccccgcgccgcaacccggctcgcccggcaccgcgacaccgacgccgtatccgcagatcacgccgatcaacattcccaagtccggcgccggcagtggcagcccaccgctggtgccgatcgagatgcccagcccgccgagcaaggatcaaccgctgcccggtatcgaaccgagcggcaccaaggcgaaatcccccggcggttaaacctgttgcgccgccagttgaccgtcggccatgcgcaggcgtttcgacagcgaaacggcgagggcgcggatgatcttcgcggcgatcttcggcgcgtcgttgagcattttttccagcgagtccttgcccaggttcaatagctgacagttcgtcgccgccacgcacgttgccgagcgtcgctcaccgtcgagcacggccatttcgccaaaggcacgcccgctgcgcagggtggccatggtgatgacctggccatcgggcccggttttctgcacggcgacctggccggtgtggaggatgcacatgaaactgccggcatcgccctcgcggaaaatcgcttcgccttcggccacggtgctgatgctgaaatagccggaagcggccgcaaagtcggccagttgcaattgatcgaacaggccacagtccatcagccagtcgcggatttcgttgttcaggaaggtcggttctgacatgtcgtcacggtctttttgtttttactgtttcaggctacatacggttccctgtaggagtgagcctgctcgcgatagcggtcggtcattcaaatcatctttaactgacataccgctatcgcgagcaggctcactcctacaggggatctgtgggtatcggcctcttgggtctgcaattaagacccaagtgaccgacggagttcctcagaccaggcccaaaaccttgaaaacaaatgcgtattcgagcgctacgtcacgtaatccctgataacgcccgctcatcccgccatgcccggcgcccagttcagtcttgagcagcaggacgttgtcgttggtcttggttgcgcgcagtttcgccacccatttggccgcttcccagtactgcacgcggctgtcgttgtagccggcgattaccagcgtcgccggataatcctgcgcggtgacgttttcgtacggtgcatacgccttgatccgctcgtaaacgtccggctcttcagggttgccccattcgtcatattcggtgacggtcagcggcaggtcggggtcgagcatggtgttgagcacgtcgacgaacggcacttcggcaatcgccacaccgaacagatccggacgctggttgagcacggcaccgatcaacaaaccaccggcgctgccgccactgatcgccagtttttcggcagtggtgatgccgttgaggatcaagaactcggcgcaggcaatgaagtcgctgaaggtgttgtgtttgtgttcctgcttgccggcgcgataccaggcttcgcccagttcaccgccgccgcgcacatgggcgatggcgaaggccatgccacgatccaagaggctcagacgggcgtgggagaaccacggatcaaggctcgagccgtaagcgccgtaaccatacagatacagcggcaccgcttggccgaccatttcgcgtttcatcaccaggctgatcggcacttgcgtgccgtctggcgcagtggcccacagacgctggctgacgtaagcgtcggcgtcgaacggaccgagcaccggggtttctttgagtaccgtctgctcgccggtggcgaggatcaactggcgcacctgtgccgggcggttcaacgcctcgtagcgcagacgaatgcgatcgctctcgaactccaggctgttttgcacatagaggctgtaggcagcatccggcagttgcacgcgatagggggccaggccgtgtgggtgaacctcgatgatcggcaggccaccttcgcgcaggctcagggtcatggcctcggtgttgaggctgacaccgtcgagcatcaccgtgtcgctgtgcgggatcaggttctgccattcggcttcggtcggtgcggtgccggtatccggggcctgatacagggcgtagttgatgccgtcgcgattggtacggataaaccacgtccacacgccatcgagcaggccgtgatcgacgtcgtattcatgatcttcgacccgtggcgccaggcaggtgaagggctggtgcggatgattggcgtcgagcgcccagacttcgctggtggtcttgctgcccagcgacaacagcaattgctgctcggagctggaacggtagcaatgcaggaagaaacgcccatccggctcatggaaaacttcttcggcagcggtgccgtcgaggcgatagcgcaacagcttgtgtgggcggtgcgtgtcgtcgagtacgccgaaaaacagggtcaggctgtcattggcccaggtcatgctgccgtcgcagttttcgaattccagttcgctgaccttgtcgttggacagttccttgacgaacagcgtgtaaatctcatcgcccgaggcgtcgacgctgtaggccagacgctggtggtccgggctgatgctgaaggcgcccagcgagaagaatccgccgttggccagcacgttcgggtcgagcagcagttgttcgcggctttcgtcgagggtcaggctgtcatcggccggacgcgggcagcggtaatgccgggcgtattcgtcaccggcggtagtgcgcgtgtaatacaggtacgggccccaaggcgagggcagggacaggtcggtttcaagaatccggcccttgatctcttcgaacagcgtttcgcgcaactcggcctgatcggcggtttgcgcctcttggtatgagttttcggccttgaggtaatcgagcaccgcgtcggtgtcgcgctcctgcagccaggcatacgggtcggcaccggcggccttgcgggcaatcggggcactgatgacgttggcggattggggcatggaaggctctcggacattgttcggaataaaggttttaacagcgcttgaaaccgccgcagaccgtgtaggagtgagcctgctcgcgataaggccggcacattcaacatcaatgttgtcaggctgtccgtcatcgcgagcaagctcactcccacaggtcgcatgtctattgggacaagcctggcgggcgaaaagtcgttactataagcgcctctttgcctgccttgccatggacaccatgaccgagaacgactatctgatcgcctggggcctctacgcctttgccgctgtgggctgcctgttggtatggatgcgcctgactacctggatgtggcgctggttgcgcgagccgttgcgcgtactgatggccgtgttgctgttcagcccgaccatcattgatccggtgaaggccaaggttgcgccgtccattgccatcactgcactggatctggccttcaaggtcggcaacaacgcctggcgcgcggtctccgacctgttcatgtacggcatgatcgcttttggcctctatctgatcttcgtgctgatccgcttcccgattgaacgtgcatcgcgtgcgcgccgagagcaggccgaggctgccaaagccgcagcccgtgccgatgaccgcaacgacgatcaaccgttcggcgctgctggtgatgaccgctacgggcgcccaccggttccgaacaatccgcagcgcatgcgggtcgagccgcgtctgtaatcccgagagtccgcacatgtgtgaattactgggcatgagtgccaacgtgccgaccgatatcgtcttcagcttcaccggtctgatgcagcgcggcggtcgcaccggcccgcaccgcgacggttggggcatcgccttctatgaaggccgtggtttgcgtctgtttcaggacccggcggcgagctgcgagtcggaagtcgccaatctggtgcagcgttatccgatcaagagcgaagtggtcatcggccacatccgccaggccaacgtcggcaaggtctgcctgtccaacacccacccgttcgtccgcgaactgtgggggcgcaactggtgcttcgcgcacaacggccagctcgccgatttcaccccgatcaaaagtttctaccgcccggtcggtgataccgacagcgaggcggcgttctgcgatttgctcaaccgcgtgcgtgcagcattcccggagccggtcgaaatagaggaactgctgccggatctggtcgccgcgtgcgccgaataccgcagcaaaggcgtgttcaactgcctgctcagcgatggcgactggctgttctgctattgctcgaccaaactcgcacagatcacccggcgtgcaccgttcggcccggcgcggctgaaggatgtcgatgtgattgtcgatttccaggccgaaaccacccccaacgacgtggtgacggtgatcgctaccgaaccgttgaccgaaaatgaaacctggacccgctacgaaccgggccaatggagcctgtggcgacgcggcgaatgcgtaagtcaaggcaagaccgaataaggatttgcaccccatgttgctcagttatctacggctggtgttgtttgcggcgggcctgttgatcggtgtccaggtgccgggtttcatcaacgattacgcgaaacgggtcgaggcgcacctgatcgaagcgcagaccggtttgcgcgggtttcagggcaccgccgagcagttcttcaaaggcgacatccaggcactggtggcgcattaccgcgccagcgaagacccggtttttcgcagtgatgccgatagcctgagcactttgctcgatcggcagatcgcgttggacaagcagttccaggcgatgcagggcccgtggtacatccgcttcctgcaagtggtgctggcggctgatccggatatccgcaaggaaacctggaacggatacagctatcagattctgctgaccccggaagcgatgatctggggcatgagcggtgcgttgctgctgtcgttcggcattgaatgcctgttccgcttgatcgattgggttgttctcggtggcaagcggttgcgtcagagccggccgatcgaagatcgcgacgtacgcggcctctaagatcagcgcagtaaggatcgttcccacgctctgcgtgggaatgcctcatcggacgctccgcgttcggctttcgagggacgcggagcgtcccgggctgcattcccacgcggagcgtaggaacgatcaacttaacgcgatgtagtccttgcccaccttgtgcgcatacccttccagcacctgctgacacaacgtcacaatctcctcgacccactcaacgcccacccgccacgacaccaccacctgcaagttcggtggccgttgatcaatcgccagcaaggtcaattccccccgcgccaattcctcagccaccagcaccggtggcagcacaccaatgccaaatccatcgcgtaacaaccgcgtgatcgccgacaccgaattcacgcagttcaagcgtggcgccagcaccccgttggcctgcatcagcgccagaagatcctgatgcggtcgggagtttttcgagtaggtgatgatgcgttcctgcgtcagttcggtgaggtcggcgtagtcacggttgtagatcgaattgctcgcgacaatccagcccagtggatgactggccagctccagactgcgcacgctttcatggcgcaccagatcggtttgcagaacgatatcgagaaagcctttttgcagctgatcgcagaggttcagcgaggtatccgccaccagttcgatttccacccgtggatacagatcggtcatctgcgccaccagcgggcttagccaggtgtggatcaccgtgtccatcacgccaatgcgcacccgaccgaccttgctcgaacgggtctcgatcgactgcctgagtgccgacatggtgtcgagcatctgttcggcatattccagcactttgagaccttcgggcgtcaggctgacaccgcgcgaatcgcgcagaaacagcttcacccccaactcgccctccagcaccgcaatgcggctggaaatcgatgcctgagtggtgaacagcttgtcagcggtcaggcgaaagctcttcaggcgtgcgacccagacaaaggtctcgagaaacttcaggttcatgggcaaggctcgggtgacaaatttttcttatggctaaggcgggtttttattcgttggacgcggcagggccgcgcgacgaaaaatcgacgcatccggtccccacgataggcgtcgtcggggctacgaacaagaccaataagaacctgcggagataagccatgagtgctcccgaaaccctagaagcatccacggcaacggcgcgtccggggccgttcgactggtatcgcaacatcaaccagcaggagcgtcgcacgttctggagctgcaagatcggctacggtctggacggcatggacacgcagatgctcagcttcgtcgtgccgacactgatcgcgatgtggggcatcaccaccggcgaagcggggctgattcacaccagcacgttgattgcctcggccatcggcggttgggttgccggaattctctctgaccgtatcggtcgcgtgcgcaccctgcaactgacggtgctgtggttcgccttcttcaccttcctctgcggcttcgcgcagaattacgaacaactgctgatcgcgcgcaccttgatgggcttcggtttcggcggcgaatggaccgccggtgcggtgctgatcggcgaggtgatccgcgccaaggatcgcggtaaagcggtgggcatggtgcaatccggttgggcgctgggctggggggtgacggcgattctgtatgcgctgctgttctcggtgttgccgccggaagacgcctggcgtgcgctgttcatcctcggcatcgtgccggcgattttcgtgattttcgtccgtcgactggtgaaggatccagagatttatcgcgaggccaaggctcagcagacgccggagaatccatcgaagttctatgaaattttcgcccccggcatgctcttcaccacgttccgcgcgtcactgctgaccactggtgctttgggcggctattacgcgatcacttcgtggctgccgacctttctcaagaatgagcgcggcttgagcgtgctcggcacgggcgggtatctggcgatggtgattgtcggctcttacgtcggctatgtgatcagcgcctacctgaccgatctgctcggccgcaaaaagaacttcattctcttcgcggtcggctccttcaccatcgttctgctctatacgcaactgccggtgagcaacggcgtgatgttgtggctgggtttcccgctgggtttcttcgcttcggggattttcagcggcatgggcgcgtttctcactgagctgttccccacgcggattcgcggttccgggcagggcttttgctacaacatcggtcgggcgctggcggcattgtttccactgctgatcggtctgcttagccagaaagtaccgttgagcgtcggcattggcgcatttgcggcggtgtcttacggcgtggtgatcatcgcggcgttgagcctgccggaaacccgtggcaagcaactcgatgcgcagtaactgataacctgcgtcgtaaagtcctacagataaaaagacaagccctacaggagtgttcaccgtgagccgcctgctattgaattgcgacatcggcgagagcttcggcagctggaccatgggtctggatgccgaggtcatgcccttcatcgattgcgccaacgtcgcctgcggcttccatgccggtgacccgagcatcatgcgcaagaccgtcagcctggccttgagccacggcgtaaagattggtgcgcatccggcctatcaggatctggccggtttcggtcgccgctccatggcgtattccgcgcaagagctgcaagacatcctgcattaccagatcggcgccctcgacggtatttgcaaggcgcagggcggacgggtcagttatgtcaaaccccacggcgcgatgtacaacgacatgatggccaacccggcgcaattgcgtgcggtgatccaggctgtggccgcttacgaccgcagcttgccgctgatgctgatggccactcgcgacaattccaccgcgcagcaagtcggtgatgagtacggcgtgaccctgtggttcgaagcgttcgccgaccgcgcctacgacagcgccggcaaactggtctcgcgacaattgccgggcgcggtgcatcacgatcccgagatcatcatcgagcaagcattgaccatcgcccgtggcgacaacctgaccgccaacgatggtagcgccttgcacctgcaagccaatacgctctgtgtgcacggcgacaacaccagttcggtggccgccgtgcaacgcattcgccacgccttgaatcagcagagcacgtcatgaacccaaggattgaagtggtggcactggattgcctgatgttgcgtttgttcgatgaaatcgccgaaaccaacatgccgtggatgctcgccgccagtgagcgcttgcgtgtggtatttggcgggcaactgatcgatctggtgccgtcgtatacgacgttgatggtgcattacgatctgacggtgttgaacccgaatcaggcgcgggcattgatcgctgaagcgttgatcgacctgtcgccgaatgcgcgaaccgctggccaatgtcatgtgctgccggtctggtatgacctcagcgtcgggcctgaattgagcttgctggccgagcgcagcgggctggcgatcgaggaggtgattcgtcgccacagtggtcgcgaatatcaggtgttcgccctgggtttcgcgcctggttttgcctttatgggtttggtcgaagagatgctggcggcgcctcgtttgaacacgccgcgcaagaaagtcgcggccggcagcgtcggcattgctgaacgccagactgctgcctatcccgtcgtgtcccccggtggctggaacctgatcggtcgcacgccggcgaaactgtttgatcgtcatcgcgatggctacagcctgatgcaacccggcgacaccgtgcggtttgaagcagtcagccacgccgaattcatccgtctgggcggcgacgacacgccactggaggcgcaggcatgagccgactgacgattgaggcgagtacgccgctgtgcctgttgcaggacgccgggcgatttggcgtgcggcatctgggcgtgacccagggcggcgcggcggattggaacgcgatgagttgggccaactggctgttgggcaatggtctggatgtgccggtcgtcgaaatcaccctgggtgggtttgctgtggtggctgacgaggattgtttgctggcactggccggggcggatctcggtgcgcaggtcgacggtcagccgttggcgccgtggcgcagtttcaagttgggcaaagggcagacgttgcgattcacgcaaccgctgtttggagcccgggcgtacctggcggcgcccggtggtttcgaggcaccgaaggtgttgggcagcagcgcgacggtggtgcgcgaacaactcggtggcttggatggcatggggttgccgttggccaagggttcggcgctgagttatcacgggggatcgcagtgggtgcgggaactgcccttggcgctgcggccggatttgaaatcgacagcacctctggatctggtgcttggcgcacagatcggccagttcagcgggcagagcgtgttcgatgtgttcaacagtgcctggacactggacagtcgcgcggatcgcatgggcattcgtttgctgggtaaggcgttggaatatcagggccagccgatgatttccgagggcattccgttgggcgcggtgcaagtaccgccggacggccagccgattgtgttgctcaatgatcggcagacgattggcggctatccgcgattgggcgcgttgacgccgttggcgttgtcgcggctggcacagtgtctgccgggggctcaggtgcggttgcggcctgtagtgcaggacgtcgcgcaccgtgagcacatcaaatatctgcagagatttggctgaagatcaaaagatcgcagccttcggcagctcctacaggggaatgcgaatttcactgtaggagctgccgcaggctgcgatcttttacttttatttggacaaaaaccgcattccttcctcaagcccgcgcaacgtcaacgggtacatctgatcctcgatcaaatccctgacgatgttcgtggaagaggtatacccccacgtatctttcggatacggattgatccagatgagcttcttgtatttctccatgaaacgctgcatccacacataacccggctcttcattccaatgctcgacactgccgccggcctgggtgatttcatacggcgccatggcggcgtcaccgatgaaaatcaccttatagtcagcgccgtacttgtgcagcagatcctgggtcgaagtgcgctccgaagtgcggcgcatgttgttcttccacaccgattcataaacgaagttgtggaagtagaagtactccagatgcttgaactcagtcttgcaggccgagaacagctcctcgcagatcttcacgtgcgcgtccatcgaaccgccgatgtcgaacagcaacaacagcttaaccgtattgcgccgctccgggcgcatctggatgttgagtagcccggcgtccttggcggtgtggtcgatggtgccgtcgatgtcgagttcttccgccgcgccctggcgagcgaatttacgcagacgacgcagggcaaccttgatgttgcgcgtgcccagttccaccgagtcatcgagattcttgtactcgcgctgatcccagactttcaccgctttgccctggcgcttgccggcatcaccaacccgaatgccttccgggttgaaaccaccggagccgaacgggctggtgccgccggtgccaatccatttgttgccgccggcgtgacgttccttctgttcttccagacgctttttgaattcttcgatcagcttgtccagaccgccaagggactggatctgtgcgcgttcttcgtcagtcagcgagcgctcgaattccttgcgcagccagtcttcgggaatcagcgcctgcaagtgatcgtcgagcttttcgaggccattgaagtaggcgccgaacgcacggtcgaacttgtcgaaatggcgttcgtccttcaccagaatcgcccgcgacaagtaatagaactcgtccatgtcggcgaaggtcacgcgctgtttcagcgcgttgatcaggtcgagcagctcgcgcaccgacaccggcaccttggcggcacgcatttcattgaacaggttgagcaacatggcatcagcctcttagcgagaaccgcgacggctcatgaacgccagacgctcaagcagttgcacgtcctgttcgttcttcaccaaggcaccggccagcggcgggatggctttggtcggatcacgttcgcgcagcaccgcttcgccgatgttgtcggccatcagcagcttcagccagtcgaccagctcggaagtcgacggcttcttcttcaggcccggcactttgcgcacgtcgaagaacacgtccagcgcttcgctgaccagatccttcttgatgtccgggtaatgcacgtcgacgattttctgcagggtcgggcgatccgggaacgcgatgtaatggaagaagcaacggcgcaggaaggcgtccggcagctctttttcattgttggaggtaatgatgatgatcgggcgcttcttggccttgatggtctcgtcgatctcgtaaacgtagaactccatcttgtcgagttcttgcagcaagtcgttagggaactcgatgtcggccttgtcgatctcgtcgatcagcagaatgacccgctcttcagactcgaaagcctcccagagcttgcccttcttcaggtagttgcgcacgtcgtggactttttcgttgcccagttgcgagtcgcgcaaacggctgactgcatcgtactcgtacaggccttgatgagccttggtggtggacttgatgtgccaggtgatcagcttggcgccgaacgactcggccagttgctcggcgagcatggtcttgccggtgcccggctcgcccttgaccagcagcggccgctccagggtgatggcggcgttgaccgccagcttcaggtcatcggtggcgacgtaggcctgggtgccttcgaacttcatctgctaatcctcgaacggtaacgccgacctgaacgggcagggcgggggcgaaataatcggatgcctgactataacgcgcaggccggtcgactgtgaacgcagacggcttattcagtctctgaatggggcgtcacatgttgactcagtctcggccgatggccagtattcaggtatcgccgatttggcgatagcctctcgggcatgacgactaaataccgatttcgcgacaaataccgcattcagttgcgcgagaaggatcacccgccgccccatgttcaccttatcggtggcggcgtggaagtgatgctgagccttgaaaccgttgaggtgatgacgggcaaggcgccgccgttgattatcaaggaagcgctggcgtgggttgcggctcatcaggtgcaactgttggaggactggaaacgatgttacccatgaaaaggcctcgtctgtcggctgtgcaagcactgtcagattttcgattggcactgacctttattgatggtcaggaactgatacttgagctcggcggggatattcacgcttatccaggtctgcaacctttgctcgatcccgaagtgtttgccactgcgacaatggacgacgacggctggactgtcgaatggcttgaacctgatatacagattggctcagacacgctttatatggatgcgctggctcaaaacgcaaccgatgagaacacccgtatttttattgattggcgcgcccgaacggggctgtctcttaatcaggctgccgaggcactgggagtcagcgcccgcagcatcagtcgctacagcaatgggcgtgaggcagtgcctcgttctctggcgctggcttgcctgggctgggattcactgcaacaaaactcaactatggctgcagaggagtcgggtcgctatatcgtcaaccgcaaaacctaacccgcatcaggcttcggccgctcataccgcgcattgaatgcctgtacgaaaccattacgcaaaatctgcaaaaacgcttcgaacgcgctgatattttgctgatgtacgttgccactgagctcaaccttggtggcgaactggtttttggcctggttcttcagcacggtttccgtgccgcccaccagtgcctcccagactgagcggaagatgcttttgttctggttttccacgtcctgttgccagttgaacacttcgacgtcgcgcagcagcggtttgatgtagccgttgacctgggcttttttggctttggcttcgatgacgacgtcaccgtggccggcattgaaatcgaatttgccataggccgaggcgaagtcgttcatgcttttgagttcgatgtctttggcgcgcaggcggaattcaaagtcttcgaaattgctcagagggtcgaatgttgcggaggtttccagcggtgcgtggccgagcagcagggctttgccttcgaagcgggcatcgcgcttgccctgttggtcgacgacgttggtcaggttgtagatgctggcctcgacgttggtggcgttcatgttgaccggcggttttgagttgaaattgcggaagctgatcttgccgtcatgaatctgcacttcgtcgagggttatcggcagcaacttgcccagttgcgcacgccagtcagtgccctgaccggtctgggagttctgcttgttggccccgccatcgacgaaattgatctcgggattgacgaatttcacttgcgccaccacagcatggtcgtaccacagcgaatgccaactgaccgccagatcgatcagcggcgcattgacgaacggcaccggcaccttgccgtcgaccttgacgattttcagaccgttgatcttgtaagccccgcgccatagggccaggtcgacatcagtgatctggccccgatagtcacccatgtccgccagtttgccgttcagatagtcgcgcaccatgtagggcagggcgatgtgcagcgctatcagcaacacaacgacgacggcgaaaatccctagtggccaactgtagcgacgcttcatgacggcaattccctgacgatgtaagcgattgactattacgccgcgcagtcgttcgacccgactggactgcgccaggcaacaggcatacctttgaaggctgaattcaacgctgcataaggacccagccatgagccgcattttcgctgacaacgcccattccatcggtaatacgccgctggtgcagatcaaccgcattgcgccgcgtggcgtgaccatcctggccaaaatcgaagggcgcaaccccgggtattcggtcaagtgccggatcggcgcgaacatgatctgggatgccgaaagcagcggcaaactcaagcccggcatgaccatcgttgagccaacctcgggcaacaccggtattggcctggctttcgttgcggccgcccgtggttacaaattgatgctgaccatgccggcgtccatgagcattgaacggcgtaaggtcctcaaggcgttgggcgccgaactggtgttgactgaaccggcgaaaggcatgaaaggcgccatcgagaaggcggccgagatcgtcgccagtgatgccgacaaatacttcatgccggcgcagttcgataacccggccaacccggccattcacgaaaagactaccggcccggaaatctggaacgataccgatggtgcggtcgatgtgctggtagcgggtgtcggcaccggcggaaccatcaccggcgtttcgcggtatatcaagaatacccagggcaaacctattctatcggtggccgtggaaccggtatcttcacctgtgattactcaggcattggccggtgaagagatcaagccaagtccgcacaagatccagggtattggcgccggtttcgtccccaaaaacctcgatctgtcgatggtggaccgggttgagcaggtcaccgacgaagaatccaaagccatggccctgcgtctgatgcaggaagaagggattctctgcggtatctcctgcggcgccgcgatggccgtcgcggtgcgtttggcggaaaccccggagatgcagggcaagaccattgtggtgattctgccggactccggtgagcgttatctatcgagcatgctgttcagtgatctgtttaccgagcaggaaactcagcagtagatccatttgattcaggtcagccagggttcaggatcgttatgttaataaatgctttgttgcgcaattcttaacactgattcttgggttgagcgggtttttcccgaggccggtagtgtttatcatggccggctgccatgccgggtaaagggcattgcgcagcgttgtctttattcaaggagttgttgatgaccgtttcgtttgccgccaaggcgtttgtgctgttgctgtttctgggcagcacgctctatgtgcatttgcgcggcaaggcgcgtttgccggtactgcgtcagttcgtcaaccactcggcgttgtttgccccgtacaacgccttgatgtacctgttttctggcgtgccgtccaagccgtacctggatcgcagcaagtttccggagctggatgtgctgcgcgataactgggaaaccattcgcgacgaagcattgcatctgttcgacgaaggctacattcgcgccgccgagaagaacaacgacgccggttttggctcgttcttcaaaaagggctggaagcgtttctacctcaagtggtacgacaaaccgctgccctcggccgaaaccctgtgcccgaaaaccgtggcgctggtcagtgccatccccaatgtcaaaggcgcgatgtttgccttgctgccgggtggcagtcacctgaacccgcaccgcgatccgtttgccggctcactgcgctatcacctcggtttgtcgacgccaaactccgatgattgccggatcttcgtcgacggtcaggtgtacgcctggcgtgatggcgaagacgtgatgttcgacgagacctacgtgcactgggtcaagaacgaaaccgaccaaacccgcgtgattctgttctgcgacgtcgagcgtccgctgagcaaccgcctcatgacccgcatcaaccgcgcgatcagcgcctggctcggccgtgccaccgcaccgcagaaccttgatgacgaacgcgtcggcgggatcaaccaggcctacgcctggagcaagaacttcagcgacaagttcagtggcgtggtcaaacagtggaaacgccgtcatccgaaagcctaccgcgtgatgcgtccggtgctggcggtgctggtgttgacgttgttggggtattggttgttcggctgaagctggatcagacaataaaaaaccgctccttgtgagcggtctttttatgaagagaaggtgaacgaagcgccagcgaggacgcctcctggctcttccgcggctggattcaccaatgcttctctgattcggtgcaactcccgttcagacaacttcccggaagagcgttttctatcagcttttatcgatctggcgcctggcgcctttttttcaacggcagccttcatggtgcctccggcgttgatcattaaatgagcagttgctcgatactagtcttaccaaatcagcttcacaagcctaccctccgaatcgaattcaaaacccagttgccggtacagggaaatcactccagggagaggttcctgaatttcaatttgggtactaccgatgattcgcgcgaagtgagtcacggcggtcaaggcaaatgtcgcaactcggcttttgagagggtgatcgttatcgggctttccttccagacgcacaattttcactcgcaaccggctctgattagggtttgcaaagcaaagtccgcataactcctgatcaaaccagattgccaaatcgaagccaagtggttctttggccttccacctgactacatcttgccaagagaaatgaggatcgaaccattcttcataggcactcagcgcttgagcatcgattgcttcgaaacgaactctggagtgatcaacatccactatcccttgctgcaacaagtctttgtgcagctttgcgaaagtaaccccggcctgtttcctggcctgtgatttatacacttggtagcgcaaatacgtccgttcccttggcatgtgatcccgtgcattccttgtcctccatggtggggtgtcgcaattgcgatccagcctattcaccttgcggccaactgtccctgctggcgctttgcccaactcattgcaatacatgtcccacgctggttatagtcggcgctcgtgagccgtaccgctcacgctccaccccttcaaaaaagatctgcgccaatgcctgcatccctcatcaacgcggtagtcgattcagcggtcaacgctggcgtcgtgccgtgcgggaatcagcagcccaggcagatcagtcattaccccccacctgtcagtagcacgccggtgtgcgcagtcgtatcaccgccgggcgttggcgtttcgggctgatcggcagtttctgctgccccctgcgcccgccagaaaaaactactgaatttcagcttcggctgagttggcttcttgcctgactacaggtggtattcatgtttgtcctgtcgaaaaaatccgcgctcgcggcgacgtccacgagcctgttcgttctgctgtggagcagcggggcgatcttctccaaatgggggctggcccacgcttcgccgtttgcctttctgctgattcgcttcgcgattgccttgtgcgggctggtgctgctggcgccgctgctcaaattgaagctgcccaagggtggcaagccgatgctgtacgcaattgccacgggcttggtgttgttgggggcgtatcagattttctatctgttggcgctgaacaccaaggtcactccgggcgtgatggcgaccatcatgggcgtgcagccgattctcaccgtggtcttgatggagcggcagcgctcggcgagtcgcctgttcggtctggcgctggggctggccgggctgatcatggtggtttaccaaggcatcggtctggccgggatgtcctgggcggggatgctgtttggtctgctggcgctggcgagcatgaccctgggctcgatcatgcagaagtgcatcaccgacaatcccctcggcacgctgccggtgcagtacttggccggtctgttgttatgtgggattttcgtgccgtttcagccattccactttgagcacagcacaggttttatcgtgccggcgttgtggatggggctggtggtctctgtgctggcaacgctgttgctgtatcggctcatcgcgcggggcaatctggtgaatgtcaccagtctgttttatctggtgccggcggtgacggcggtgatggactatctgattttcggcaatcgcctggcggcgttgagtgtgctgggcatgctgttgatcgtcatcggcctggcattcgtattccgtaaatcccgataacgcgaaccccggtaggagctgccgcagactgcgatcttttgatcttgtttttaaagacaggatcaaaagatcgcagcctgcggcagctcctaccgggtattcacttcaacaggttttagcgcagcaggcttcaacaccagccacaacgccgccgcaatcagcaccccgccatacacatgcgccatcgacaacggctcatccagcagcaacgccccccacaacacgccgaacggcggaatcatgaaggtcacggtcattgatttcaccggaccgatcgaactgagcaggcggaagtaaatgatgtacgcaaatgccgtgcaccccaggcccagaccgagcagcgacagccagacattccagccaccccaactgagcggtggcgcgctgatgatgctgaaggcgaacagcggcaacaggaacaacgtcgccccgagcatgctgcccagtgccgacaggcgtgggtcgaggccgccggcctgatccagccagcgccgtgcgaggaacccggcaaagccgtagcaagtggtcgccagcaggcaggcgagggcgcccatcagcagttgcagatcgaatgccatgggaccggcacgggtcagcacaccgacgccgaacagaccaagaaaaacgccgctgaacttggcgatggtgagtttctcactgaaaaacaacgcgccgatcagcacccccatcaacggtgtggtggcattgaatattgccgaatacccagcgggcagcacttgcgcggcgactgaatagagcgttgccggcagcccggaattgatcacgcccagcagcatcacggttttcagtttgcctttgaaatcccgactgatgcgcatcagcccaagaatgaccagcagaccggctgcggcgatcgatacgcgaaagaacgccgtcgggaccgagccgatcaccggcgcaatcacgcgcatgaacagaaaactcgcgccccagatggctgccagcgacaacatgcggaaaatatcgacagggctcacggcggggctccttccttgatcgggacgagagtgttgccgaggccccatatgatggcaaccgctaatcggacatttaattttccgtagccgccgcgtctgcccggaaaaccccggtcggttacaactggcatggcatttggcagaaattgcacttcacctgcgcacgcatccgtggctaagctcaggcacagatttcccaacgcacgccgaggtctcatctatgccgcagcaatggccagccaccgacatcgcccgcatgatcctcgatggctttgacgattaccgcgagcatttccggcggattaccgacggcgcccgggagcgtttcgagcaggcgcgctggcaagagacgcaaaccgcgtcggcggcgcggatcaacctctatgaagaaaaggtcggcgaaaccatcgcccgcctgcgcgaatacttcgacgatgaaacgctgatgaatgtcagctgctggccactggtgaaaagcgcctacatcagcgttatcgacctgcgtttcgacgatgaactgtccgagacctggtacaactcgattttctgcgggctgttcagccacgacctgatcagcgacggctgcatgttcatccacaccacgcgtccgagcctgcgccgtgcccgcgccgcgcaaacccgtacgtacaaaccgcaagggcaattgtcggggatgctcgcgagcatttttgccgactaccgtttcagcgaggactacgccgatctgcccggcgatttgctccggctcgaagcacaactgcgcgagaacctgccggactgggtgtgcaaagacccggaactcagcgtcgagctgttttcttcggtgctgtaccgcaacaaaggcgcgtacctggtcggacgcatttacacccgcgacgagcaatggccactggtgattccactgctgcaccgcgaagggcgcgggatccagatcgatgcgctgatcaccgacgaagccgaggtgtcgatcatcttctcgttcacccgttcgtatttcatggtcgacgtgccggtgccggcggaatttatcggttttctgcggcgcatcctgccgggcaagcacatcgctgagctgtacacctcaatcggcttctacaagcacggcaaatccgagttctaccgcgcgctgatcaatcatctggccaacaccgacgaccagttcatcatggccccgggtgtacgcggcatggtcatgagcgtgttcaccctgccgggtttcaacaccgtgttcaagatcatcaaggaccgtttctcgccgtcgaaaaacgtcgaccgcgccacggtgatcgaaaaataccgcttggtgaaaagcgtcgaccgggtagggcgcatggccgatacccaggagttcgccgacttccgttttccgctgagcaagttcgatccggcgtgtctggaggaattgttggaagtggcgccgtcgacggtttcagtcgagggcgacactgtgttgatccgtcactgctggaccgaacggcggatgaccccgctcaatctgtatctggagaacgccaacgatgcacaggtgcgtgaggcgctggaggattacggcctggcgatcaaacaactggcggcggcgaatatctttcccggcgacatgctgctgaaaaacttcggcgtcactcgtcacgggcgggtggtgttttatgactatgacgagatttgtttcctgaccgaagccaacttccgccacatccctgcaccgcgcacgccggaggacgaaatggcgtccgagccgtggtactcgatcgggccgctggacgtgttccctgaggagtttccgccgtttctgttcgccgattcgggacagcgcaagttgttcgatcagttgcacggcgagctgtacaacgccgattactggaagagcctgcaggaagcgattcgcgccggcaaagtcatcgacgtcttcccatatcgccgcaaaggcctcgataacgaataactccccctgtaggagctgccgaaggctgcgatcttttggttttgcttttaaaaaacaagatcaaaagatcgcagccttcggcagctcctacaggggaagcaggccaatcggaggcaaatctgcgacaatccgccccctgcataaatagacgaccgaattgcctacccgatgaccgacgaatcgccctccatcgacaaactgctgaaaaacctcgaccacgccatgctcgccgaccgtcaccggctgcggcggcagttgcttgagctgcgcaagaaacccgatgaggccaaactggcccaatgggtgacgcgcatgcaggcgtcctgtgatcaggtgctggcccgcaaggccagcctgccggtgattcgttacgacgacagtttgccgattgccgccaagcgcgacgaaatcaagaaggccctggaacagcaccaggtcttgatcatcgccggcgaaaccggttcgggtaaaaccacccagttgccgaaaatctgtctggagatcggtcgcggccagcacggcttgatcggccacacccagccgcgtcgaatcgctgcccgcagcgtcgccagccgcgttgccgaagaactcggcacgccgctcggttcgctggtcggctatcaggtgcgtttcgaagatcagagcgattccaacaccctgatcaaactgatgaccgacggcatcctgctcgcggaaacccagaacgatcgctacctcgaacgctacgacacgatcatcgtcgacgaagcccacgaacgcagcctcaacatcgactttctgctcggttacctgaaaaccctgctaccgcgtcgtccggatctgaaagtcatcattacttcggcgaccatcgatctggagcgcttctccaggcattttgatgatgcgccgattgttgaagtgtccggtcgcaccttcccggtggacacctggtatcgcccgctgacactggagcaggacgaagagggcaaccgcgtcgaggatgacctgaccgtcgatcaggcgatcctcgcgaccctcgacgaaatcgccgcctacgaacgcagcgaacgccgcagtcccggtgacgtgttggtgttcctgcccggcgagcgtgagattcgcgacgctgccgacatgctgcgcaaggcgcaaatcaaacacactgaaatcctgccgctgtacgcgcgcctgtcgccggccgagcagcagcggattttccagtcgcacccgggccgtcgtgtggtgctcgcgaccaacgttgccgaaacttcgttgaccgtgccgggcatccgctatgtgatcgacagcggcaccgcgcgcatcagccgttacagctatcgcgccaaggtccagcgtctgccgatcgaagcgatttcccaggccagcgccaatcagcgtaaaggtcgttgtggccgggtcgagccgggtatctgcattcgtttgtacagcgaagaagatttcctcggccgcccggaattcaccgatccggagattctgcgcaccaacctcgccgctgtaattttgcagatgctgcatctgcgcctcggcgagatcactgcgtttccgtttattgaaccgccggatggcaaggcgatcagtgacggtttcaatctgctgcaagaactctcggcagtggatcgcaacagtcagttgaccccgctcggtcgccaacttgctcgcttgccggtcgacccgcgtatgggccgcatgctgcttgaagcagccaagctcggcagcttgcaggaagtgctgatcgtcgccagtgccatgtcgattcaggatccgcgcgagcgtccgccggaacgtcagcaagcggctgatcaggcccatgcccaatggaaagacgttgattccgacttcgctggattagtgaatctgtggcgtggctttgaagaacaacgccaagcgctgacggcaagcccgttgcgtaactggtgccgcaagaacttcctcaactatctgcgtttgcgcgagtggcgcgattcccatcgccagttgagcctgatctgccgcgacatgcagttgagcctgaacaaagagcctgccgattacccgaaactgcacaaagcggtgctggtcggtctgctcagccagatcggccagaaaaccgaggacggcgattaccttggcgcgcgtcagcggcgcttctggattcatccgtcgtcgggcatcggcaagaaacgtccgcaatggctgatgaccgccgaactggtggaaaccaccaagctttacgcgcgcatggtcgccaagatcgacgccgactggatcgagccgctggccgggcacttgatcaagaaaaaccacttcgaaccgcactgggaaaagaggcgtggccaggttgtggcctacgagcagatcactttgttcgggctgatcgtggtcggtcgccgtccggtgcattacggcccggtcgatccagtggtttcccgtgagctgtttatccgcgaagctctggtgcgtggcgagattcagtcgaaggccaaatgcctgaccgccaaccagcaactgctggagcagctcgacgaactggaagccaaggcccgtcgccgcgacattcttgctgacgaagaaaccctgtacgcgttctacgatgcgcgtttgcctgcggagattcaccagaccgcgaccttcgacagttggtaccgcatcaacagccagaagaacccgcagctgttgatcatgcgcgaagaagacgtgctggcccgcgaggccagtgaagtcaccgcgcgcgattacccggacacgctgcacatcggcgatctggaactggcgttgacctatcacttcgaacccaatcacccgcgcgacggcgtgaccctgcgggtgccggcgccgctgctgccgatgctgccgccggaacgtctggagtggctggtgccggggctgatcgaagccaagtgcatcgccctcgtgcgcaacttgccgaaagcgctgcgcaaaaacttcgtgccggtgccggacttcatcaaagcggcattgcagcgcatgacctttgccgaaggttcgttgccgcaggcgctgggtcgtgagctgttgcgcatgaccggtgcgcgggtcagtgatgaggcgtgggccgaagctgaacagggcgtcgaagggcatctgcggatgaacctggaaatcgtcgacggccaaggcaaattccttggcgaaggccgcgatctggccgaactgaccgcacggtttgccgaggccagtcaggccgcgttggccgtgccgcagagtgcgaagagccagcagccggtggaggcgaaagtcttcgcgccggtggcagagaagacccaacagaagatcgccgggctgtcgatgacggtgtatccggcgctggtcgaagagggtggcacggtcaaggaagggcgcttttcgaccccggccgaggccgaattccagcatcgccgcgccttgcagcgtctgctgatgcagcaactggccgaaccggcgaaattcctgcgcagcaagttgccggggcagactgaattgggcctgctctatcgcgagctgggccgggttgatgcgctggtcgaggacattctgctggccagcctcgatagctgcattcttgaaggcgaagatccgctgccccgtgacggcgccgggttggcggcactggccgagcgcaagcgcggcagttggaccgagcacgccgagcgcgtggcgcggctgaccctggagattctcaagctgtggcacggtttgcagaaacgcttcaaaggcaagatcgacctcgctcaggcggtggcactgaatgacatcaagcagcagatcagccatctggtgtatccgggttttgtccgtgaaacgccgatgcagtggctcaaagaactgccgcgttacttgaaggcggtcgagcagcgtttcgagaagcttggcgcgcagttgcagaaggatcgcgtctggagcggcgaactcgccggcctctgggcgcaataccaggctcgcgccgccaagcatgcgcaggaaggcaagcgcgatccgcagctggagttgtaccgctggtggctggaggaataccgggtgtcgctgttcgcccaacagttgggcacgaaaacgccgatttccgacaaacgcctgaacaagcagtggactcaggtcgaaccgtaacgctgatcgttcccacgctctgcgtgggaatgcctctggggacgctccgcgtccagtgacgcggagcgtcacgggctgcattcccacgcaggagcgaggggacgatcatccgtgttgatcttgagaaaggcgccaaaagcctgcgtttatggcaaacttcgcgaccataaacgccggtttcgcgacccagagccttcggccgtggtgcgagacggaataaagcgatgccaggtttgcgtcccccggatgggaatagaccctttgtgtgttggtacgacggttccagcactttctgcctgaacagattagagaaacgaccatgcataacgtcgtcatcagcggcaccggcctgtacaccccggccaacagcatctccaacgaagagctggtgcagtctttcaatacctacgtcgcccagttcaacgctgacaacgcccaggccatcgccagcggcgaagtacaggccctgaccgaatccagcgccgccttcatcgaaaaagcctccggcatcaagagccgctttgtcatggacaaggacggcatcctcgacccgcaacgcatggccccacgcctgccggagcgttccaacgacgaatggtcggtgctttgccagatggccatcggcgctgccgaacaggccctgcaacgtgccggcaaaaccgcagccgacatcgacggcgtgatcgttgcctgttccaatctgcaacgcgcctacccggccatcgctatcgaagtccaggaagccctgggcattcaaggcttcggcttcgacatgaacgtcgcctgctcctcggcgaccttcggcatccaggctgcggccaacagtgtgcaactgggtcaggcgcgggcaatcctgatggtcaacccggaagtctgcaccgggcacctgaacttccgtgatcgcgacagccacttcatcttcggcgacgccgcgactgcggtgatcatcgaacgtgctgacacagcgacgtccgagcaccagttcgacgtggtcagcaccaagctgctgaccaagttctccaacaacatccgtaacaacttcggcttcctcaaccgcgcagctgaagagggcatcggtgcccgcgacaagctgttcgtgcaagaaggccgcaaagtgttcaaggatgtctgcccgatggttgccgaactgatcggcgagcatctgcaagagaaccagctgaatgttggcgatgtgaagcgcttctggctgcaccaggccaacctgagcatgaatcacctgatcgtgcgcaaactgctgggccgcgaagccaccgaagaagaagccccggtgattctcgacacctacgccaacaccagctccgccggttcggtgattgcgtttcacaaatatcaggacgacctggccgccggttcgctggcagtgctgagttcgttcggcgccggttattccattggcagcgtgatcctgcgcaaacgttgattgcgccttgaaagatcgcagcctgcggcaactcctgcactgacccttgcaggagctgccgcaggctgcgatcttttgctttcagagaggtaatgcatggccgcaatggacgacactcaactgctcgaacgcctgctggccggtgagcaacaggctttcaaggagttggtcagcacctaccagagcgccatgcgcgccgtggcctatgccatcgtcggtcagcgtcatgtcgaggaagtggtgcaggacgcctggctctccgtggtgcgccatattggcagcttcgaaggccgctccagtctcaagacctggctgctgaccatcaccgccaactcggcgaaaagccgctacaagcaaaatcgtcgtgaagtgtttatggatgacctgccatcgccccacggcagcatcgatgacgaccgcttttctcctggtgacggccattggctgatcgccccgttcgcctggcatcaggacaccccggaagccttgctcaccgaaggtgaattgcgtgactgtctggagcacaccttgctcagtctgtcggagctgcaaagcagtgtgttgctgttgcgtgagcgtcagggcctggagctggaggagatctgtaatctactggagatctctctctccaatgtccgtgtgctgctgcatcgtgcgcggctgaaagtcttcgccacggtggagcattttgaggagaccggcgaatgctgacctgtaaggaacaagtggcgcgctccagcgattatctcgatggccagttgagctttcgcgaaaaactgatggtgcgccatcacctgatgttctgccctaattgccggcgcttcattcggcagatgaaattgatgcaggccacgttgaaggcgatgccggagaagccgcaagagggtgtggataccttggcagagcgcctggccgagcaacgtcgcaaagaccgcttttcgtaggagctgacgagtgaaacgaggctgcgatcttttgatcttgttttttaagatcaaaagatcgcagcctccggcagctcctgtaaagggaatagctcggtgcggatgaaacgaacggatgatggggatcgttccgcccgcaccgggctatagggtgaagcgtttttagaacttggcttccgcatccagctgcagggtgttggcgtcagcatcacgctgggtacggctggcaaagtcggccttggtcaggaagtacgtggcgccaatggcgaagttcttgtcgatgtcgtaaccgaccttgaacttgtggccccgggaaccggtggtaccgttggcgaagtcggagtcggtgaaggcgccgaccacggcgttgcgctgcacgtcacggtagttgtaatcgaggttcaggccgaagactttcgacttggcaccgaccagccatgcagtgtcctgatcagtcacggcatcgttgttcttcacgtactgaccgtagaacgacagtggcattggcagaccaccgatgtcgacctggctgaagccttcatacagacggaattcgttgtcagccgagttgccgttgaccgccagggcgcaaggtgtggaagtcccggtgcagcggctgtcttcatcgttctggtaggcgtagacgctgccgcccaaagtcactttgaggttgtcggtgatgttgaagcggctacccaactggccggcggtcagacgcaggtcgtgacggaattgcacgccatcgccgtcgacgttgtccttgaggttgtagttacccaggctgccgaacagttcggcgctgctgcccagtggatacttgtaggtaacggccagaccttccgggttgatgtcgctgtcccagatcacgtcgcccatgctgacccacggctggagcatcttgccgccgatgatgtgcaggttcttgatctgatcggggtggtagtcgatatagcccaggtcgagccagatctgcttcttgtcgaagtagttgtcctgatcctggttggtcgaacgggcatcgtcgccgccgccagtggcgatacgaatgccggtgtcgacctgcgggttgatctcggtgtaggcacccagacgggcacggatacgctgacgatccttgtcgcggccgccgttgttcggctcgccgtcgatcttgatggtttcctgacgaatacgtacgtcgcccttgaactgggtcttcgcggcccaggccagtttctggtcgaaaacgctttgttcgttggttttcttcgcaacggcggcgacttgttcgttggtctcttgctgcgcctgctgcgcgatttgctgagccttctgatccttggccagttcagtttgcagttctacgtactgcgcctgggaaatcgaaccgttagccttgagcatgtcgagcagtttggcgtcgactgcagcactggccggaacgctcatggccagcaacaagccaccgcacagggccgccgcagttttcgtggaagcaagacgcatagcaatctccgaagatgagagaggatggctgaaccatcctgggcacaaccgacgcagtgaacgtcggaaaacagtgtccgggtagaacccggcgctctaaaaacaggcgccagtatcgcgatggtttatgacagagcagtggcacagtgatggcaggatgatgacgatacaaaatgctcgtgaactactgatctagagcgctgtcgccccaatgcgggtgtgtattgcggcgcaatcggcgatactcgtccagcgctgaagtcctgttatggagagcccgtcgatgccgttgcaacgcctgcaaaatctgtcagaaatcgccccggccagttgggatgcactggtaccggagaaccagccgttcttgcgtcatgcgtttctaagtgcgctggaagacagcggcagcatcggcccacacaccggttggcaagcggagcatttgctgcacatcgaagcggatcgactgatcgccgccttacccagctatcgcaagtggcactcctatggcgagtacgtgttcgatcacggctgggccgatgcctgcgcccgcgccggtattgattactaccctaaacttctgactgccgtacccttcagcccggtcagcggtccacggttgttggcggctagcgtcgaggatggtttcgaactgctcaagagcctgccggggtatctggaaatcgaagggctatccagcgcgcacatcaatttcaccgaccttttcaccgacgccgcgatggccgagcaaccgggctggttgcaacgcatcggctgtcagtaccattggcaaaatcgcggctatcgcgactttcaggatttcctcgacgtactcagttcgcgcaagcgcaaacagatgcgtaaggaacgcgagcaagtggcagggcagggcttcgagtttgaatggctggaggggcaccaactggatgaggctcgatgggattttgtctatgcttgctacgccaacacctatgcagtgcgccggcaagcgccctatctgacccgggaatttttcagcttgctcgccgaacgcatgccggagtcgatccgcgtggtgctggccagacatggctcacggccggtggcgatggcgttcagtctggtcggcggcgacagtttctacggccgctattggggctgcctggccgagttcgatagcctgcactttgaaacctgtttctatcagggcatggactacgcgattgcccatggttttcagcgtttcgatgcgggagctcagggcgagcacaaactgattcgggggtttgaaccggtgatcacgcattcgtggcactacctgcgtcatccgggattgaaagctgcggtcaaagacttcctgcaccaggagcgcgcaggtgtgctcgcctatgcgcaggaagcagttgccgcgttgccttacaaacaggtttgagctttggcatcgcacgcgaaactgcaaaaagccgctgacaacaaggcccgacagtttgctcgggccttgttggttcaactaaaaatacactcggttaccagcttgcacctgctacacaattgcttaaccctttctgcgaggatacgttgttaaaatcctcaagagtggcaatcgaagaataataataaatcatcagatttggttttttggcgacctgacaggtatatatgaactccggtcgatcacattggacttttcccgtgttagcgttggcggaacaatttagttccgggcgaacttcagacagcgcttcacccatgttgaattccagaggtgagtcgctattgaccgttggcgacagcatggcagaagcaaaacctgaataagttgcaatgatcagtacggcggcgattagacttttgtaatatttcatttacttaccactcccagtggctgctattatcttcaaatacccagaccttgcattttttcaggtccagagccttggcggactcggtctccatgaacgcttcggctgtaggcgcgtcgctataaaagcctttaagcttccagatgtagcccttgaaatcctcgctgtattgctggcagcgataaacgttagtgccggtatcatcggctacagcattgttttgcatcagaccagtagtcaaggcaatagcgatgatgctgttgattaaagtgttcatgcctcaatccttgagagatttgtgtgttggtggtgaagaaagttgcttttgtttgcggggtcaaaggtaatacgcttagaggcgtctgtcagcgttttcgctgtttcagaatattttatatagtgtgtgaatgtaattgaaggccgtatttttagtttaactaatacggccttttagttgcgtgaggtttagtttttttcgtcagccagccatcgataaattccaccgcctgccactgcgcctatcaacggtgctacccagaacatccacagttgcgcaatggcccagctgccaaccatcagtgccggtccggtgctgcgcgccgggtttaccgaggtattggtgacgggaatcgagatcaggtggatcagcgtcaagcccaatccgatggcgataggcgccagcccaggcggtgcacgtttgtcggtggcgccgaggatgatgatcacgaacatcgcggtcatcaccaactcagtgacaaaccccgccgccatcgaatatttgcccggcgagtgctcgccataaccgttggacgcgaggccggcggcaatatcaaaaccttccttgccactggcgatgtgagcgatcagcgctgccgcgaggatcgcgccgagcacttgagcaatgatgtaagcaggtaactctttggccggaaagcgaccgccgacgaacagaccgaccgacacggccgggttgaggtgacagccactgatgtggccgatggcgaatgccatggtcaacaccgtcagaccaaacgccagggcaacccccagcaccccgattcccaacggcgaggacgcggcaatcaccgcgctgccgcaaccacccaataccaaccagaacgtacccaacaactcagtgactgaacgtttgaacagagacatgagagagtccttgataggcgtgctatcgagactgcatcgagttgtgcatccttgcagacttacgacaggccccgttctggaaccttggctgagtacagcagggtttttacggatttccagcggccaaaaaaaaccgccagcgcccgtggttggcggactctggcggtgatcgttcccacgctctgcgtgggaatgcttcaagggacgctccgcgtccagtgacgcggagcgtcacgggctgcattcccacgcagagcgtgggaacgatcttggaggggtcagtcgataccgacaaatcctccggtctggtgcgcccacaatcgcgcatataacccacggtgagccagcaattcagcgtgggtgccgctctcggcgatcttgccgttctccagcaccaccagtcggtccatccgggcaatggtcgagagccgatgcgcaatcgcaatcacggttttgccttgcatcagggtttccagactttcctgaatcgccgcttcgacctccgaatccagcgccgaggtcgcttcgtccataatcaggatcggtgcgtctttgagcagcacccgcgcaatcgcaatgcgctgacgctgaccaccggacagtttcaccccgcgctcgcccacgtgagcgtcgaagccggtacggccctcggcgtccgacagtagcggtatgaattcatcggcgcgggctttgtgcaccgcgtcccacagctcggcgtcggtcgcctccggtttgccgtacagcaagttgtcgcggatcgaacggtgcaacagcgaagtgtcctgcgtgatcatgccgatgcgtgcgcgcaggctttcctgaccgacttcggcgatgttctggccatcgatcagaatccgcccgccctcgacgtcatacaaacgcagcagcaggttgaccaaggtcgacttaccggcccccgacggcccgatcaagccgattttttcgcccggtctgatgttcaggttgagatcgccgatgatgcctttcttcttgccgtagtgaaaatccacgtgctcgaaacgcacttcgccctgggctacatccagcggtttggcctgttcgcgatcggtgacgctgaccggttgcgagatggtctgcaaaccgtcctggaccatgccgatgttttcgaaaatgccggtgaccacccacatgatccagccggacatattgacgatgcgtatcaccaggccggttgccagggcaatcgccccgacggtgatcagtgattgcgtccacagccacaaggccaggcccgtggtgccgacgatcagcaggccgttcatggtggtaatggcgatgtccatgctggtcacaacgcggcccgccagttgggctttttcggtctgttcttcgattgcttcgcgggcgtattgctgctcgtaattggtatgggcgaacagcttcagggtggcgatgttggtgtagccatcgacgatccgccccatcagtttggagcgtgcatcggaggacaccacggagcgttccttgacccgtggcacgaagtaacagagcgcgccaatgtacgcggcgatccacgtcagcaacgggatcatcaggcgccagtcggcctcggcgaacagcaccagcgagctgatcgcgtagatcagcacatgccacaacgcatccaccgcttgtaccgcagagtcacgcagcgagttgcccgtctgcatgatgcgttgggcgatacgaccggcgaagtcgttctggaaaaaattcaggctttgcttgagcacgtagctgtggttttgccagcggatcatgctggtcatgctcggactcagggtctggtgcaccagcaggtcgtgcaggccgacaaagaccgggcgcaagatcagcgcgaccacggccatccaggccaactccaggccatgctcgtgaaaaaagttcgggttcggtgcgccttgggcgaggtcaatgatgcgactgaggtagctgaacaacgccacttcgatcaaggcgccgaacaatccgacggtgagcagggcggcaaaactcggccagacctgcttgaggtaataggtgtagaagggcagtacgcgatccggcggggatgccgtgggggcatcgcggaacacgtcgatcagttgttcgaaacggcgatagagcatcagataaccgcccggaatccgggctctccttttatcagtgtgagcggcgcggtgttgaaccgcgccgctcgatacgccctgtacagcttagtcgatgactttggccgacttgatgatcacagggtctacaggcacgttttgcatgccgcttttggtggtggtttgcgagttgacgatgatgtcgaccacgtccatgcccttgaccactttggcgaacaccgcgtaaccggcgtcacggcccggatcgaggaaggcgttgtcggcgacgttgatgaagaactggctggtggccgagtcagggttggaagtgcgcgccatcgacaaggtgccgcgcacgttgtgcaggccattgctggcttcgttcttgatcggcgccttggtttctttttgctgcatctgctgggtgaaaccgccgccctgagccatgaagcccgggatcacgcggtggaaaatggtgttggtgtagaaaccgctgttgacgtaatccagaaaattcttggtgctgatcggtgccttgaccggatccagttcgatttcgatctggccgttggtagtgtccagcagcacgtgcggtgctttggctggcgtggcagccatcaggttggcggcaaacagcacggtgccagcggcgagggcgagttttttcagcatgggtcagtgatcctgagattgaatttcggctgcggcgaggaactccagcagcgtttgattgaagcgttcgggttgatcgagcggggtggcgtggcgcgaatcggcgatcaccaccagccgcgcattcggcagcagttttacataggtttctttcaatgccaccggtgtgtaatcacggtcggcgctgatgacgagcgttggacaggtcacccgggaaagtcgttcctgaacgccccagccaacaatcgcatcgaagctggcgagataagcacgtttgtcgttttttgcccagcgttcggccattttctgccgcagaccggcttgttcgggtttcgggaaaagtttgccgccaagggctttgccaatggtcgcgaggctgagcacgcgcatcaggctccagcgtttgaaccactgccaaaaatcgtcgcggctgcgtaatttgacctccggtgcgctgttgacgatggtcaggctcttgagccgttgcggctgatcgacgccgaactggaagccgatcatgccgcccatcgacagcccgacgtagtgcaccgggccaaggttcaaatgctcgatgagtgcaagcatgtcagcgctgaatccagcgatgctgtagcgctcgtgtggcttgtccgagcgaccgtggccgcgaatatccgggacgatcacccgatagtgcgcggccagtgccgggatctgcatttcccagtccagcgtgcttgaaccgagcccgtgaaccagcagcaacggcgtaccgtggccatattcctcgtagtgcaggttgcaaccatcgtgctcgaaataggccatcggtgaactccgtgtcaggcttgttcgggggcggcgtacggcgcatccagaggtaacgtatcgaaggtgcgcagcagttcgatgaggatttgcgtggccggacccaagggtttgtccttgttcgaatacaggtagaagctggaattgcgagtgccgcccctgtccaacggtagcagcttgagcgagccatctttcagttctcgttcaatcatgtgccggggcagccaggcaaagcccagaccgctgctgacaaaggttgcggcagtggcgagactgcccacggtccagcgctgttcggcgccgagccagccaacgtcgcggggttgctggcggccggagtcgcggatgaccacttgcatctgggtttccagatcctgaaagctcagttcgcgattgagccggtgcagcgggtgatcggggtgggcgacggcgatgaactcgacgtcgctcaattccgccccgaggtggccgggaatgctcaggccagtgatcgccagatcggccacgccttcgagcaacacttcctcgacgccggacaatacctcttcacgcaagcgaacccggcaaccacgactctgcggcatgaacgcggtcaacgcgcgcacgatccgcgcgctcggatacgccgcatcgactaccagccgcacctcggcctcccagccttgctccatgtgatgggcaaggtcttccagttggctggcctgtttcaccagttgccgcgagcggcgcagcaatacgccgccggcttcggtgagcacggctttacgcccgtcgatccgcagcagcggcacgccgagttggtcctgcatgcgggcgacggtgtaactcaccgacgattgcgaacggtgcaaggcctcggcggcctgggcgaatccgccgtggtcgaccacggcctgcaatgttcgccattgatccagggtcacgcggggcgctttcatcaatagctcctcttgtcctaagctggccgtccttcatggagactgccgaatgaaaaaattctgttgtgtggtgctggcgttgctgccgctgactgcttttgcgtacccgatcgatgtgcagaaagatctcaatggcatgaaaatcgattacgaaaccttcgacaccgataacgacatcggctcgatccgggtggccaactacggcgatgtcgatgcagtgtgcaaggccgttttcagcaatggccccgaggcgccacgcactcgcaccatcgacgtaccggcaggcaaacataaaaacgccacggccaagttcacccgcgagatcatcaagctgcgcatcaagctgacctgcaccccgaagtaacgatcgaacccttgtaggagtgagcctgctcgcgatagcggtgtgtcagattgatacaccgctatcgcgagcaggctcgctcccacaggtttcaggtgcatctaaacgaattattcgatgctttgcagcaattatttgcgctttttcatcgaggcggcactgtttaaccttcactccatcgacctacaacattctcggatggaggctacacaccatgtcccgcgttctgatcatcgaaagcagcgcccgccagcaagactcggtttcccgtcaactgacccagaccttcatcagtcagtggaaagcggcgcacccggccgatcagatcaccgtgcgtgacctcgccgtgaatccggtaccgcatctggacagcaacctgctgggtggctggatgaaacctgccgaacagcgcaacgacagcgaacaagcgtcgctggatcgctccaacgcactgaccgatgaactgctcgccgccgacgtgctggtgatggccgcgccgatgtacaacttcgccatcccgagcaccctcaaggcctggctcgaccacgtgctgcgtgccggcgtgaccttcaagtacaccgaaaccggcccgcaaggcctgctcagcggcaaacgtgcctacgtactgacggctcgcggcggcatctacgctggcggcccagccgatcatcaagaaccgtacctgcgtcaggtcatgggcttcatcggcatcaacgacgtgacgttcattcacgccgaaggcatgaacctcggtggcgacttccaggagaagggcctgaatcaggccaacgccaagctgtcccaggtcgcttgatatgttaatcgccagataatcgccgattgtttaagtgacctggcgcaaccccttcaaggctctacgcgcatcgaacctccctttgcacttgttgctcctgagtgctgtagcccgattgaacgcattagcgagatcgggcttttttttgcccgtaactcaccgatcccctgtaggagctgccgcaggctgcgatcttttgctcttgtttttttttaagatcaacatcaaaagatcgcagcctgcggcagctcctgcagggggatttttgttggttgcagggtggaaaaaccgctatcgtcgccgccattcaaattaggggcgagcatgggctatctactttttgtcacgctgatccaggcgttttccttcagtctgattggcgaatacctggccggtcatgtcgacagttacttcgcggtgctggtgcgcgtggtgctggccgggctggtgtttatcccgctgacccgctggcgctcggtcgaaccttcgttcatgcgcggcatgctggtgatcggcgcgttgcagttcggcgtgacctacgtctgcctgtacctgagcttccgcgtgctgaccgtgccggaggtgttgctgtttaccatcctcacgccgttgcacgtgacgttgatcgaagatgcgctgaaccggcgcttcaatccgtgggcgctgatcgccgcgctagtggcggtgggcggcgcggcagtgattcgcttcgacagcatcagcccggacttcttcatgggcttcttgctgctgcaactggccaacttcacctacgccgcagggcaagtgatgtacaaacacctggtagccaggcacccgagcgatctgccgcattaccggcgtttcggcttcttctacctcggcgcgctggcggtggtgctgccggcattcctgatgttcggcaaagcgaatttcctgccggaagcgccgctgcagtggggcgtgctgctgttcctcggtctggtctcgaccgcgctgggcatgtactggtggaacaaaggcgcgtgcatggtcaacggcggcacgctggcggtgatgaacaacctgcatgtgccggtgggcttgctgctgaacttgctgatctggaatcagcatgaggaactgggacggttgttccttggtggcagcgtcatcctcgctgccgtatggatcagccgactgggcatccgcaaatccccagccaccgcataacccctgtaggagtgagcctgctcgcgatagcggtgtatcagtcaatatggatttgtctgacacaccgctttcgcgagcaggctcactcctacagttttgatcggtggggttacatgaggtgcttctgcggctcgggaatgctcgccgcgccgagcaccgccggcaacaaccccgaccgcaaatccccgccactcggctgttgatacaggctcagcccaaactccggcaacaccgccagcagataatcaaaaatatccccctgaatccgctcgtaatcggcccacgccgtggtgcgggtgaagcagtagatctccagcggaatgccctgcgccgtggtctgcatctgccgcaccatgcaggtcatgttcggctgaatctctggatgactcttcagatacgccagtgcatacgcgcggaaggtcccgatgttggtcatgcgccgccggttggccgacatcgccgcgacattaccctgggcctcgttccacgctttgagctcggcttttttgcggctcatgtagtcggtcagcaagtgcacttgcgagagtttttcttcctcgtcatcacggatgaaacgcacgccgctggcgtcgatgaacacgctgcgcttgattcggcgcccgccggattgctgcatgccgcgccagttcttgaacgactcggacatcaaccgccaggtcgggatcgagacgatggtcttgtcgaaattctgcaccttgaccgtgtgcagggtgatgtcgaccacatcgccgtcggcgccgacttgcggcatctcgatccagtcgccgacccgcagcatgtcgttgctggtcaactgcacgctggcgacaaacgacagcagggtgtccttgtagaccaacagaatcaccgccgacatggcacccagaccggagagcagcaacagcggcgagcggtcgatcagcgtggcaacgatgatgattgcgccgaacacgtacaagaccattttcgccagttgcacatagcccttgattgagcgcgtacgggcgtgttcggtgcgtgcatagatgtcgagcagggcgttgagcagggcgctgactgccagcaacaagaacagaatggtgaacgacagcgccacattaccgaggaaggtcatggcggttttgctcagttccggcaccagatgcaagccgaactgaatgaccagcgacggcgtcatctgcgccagtcgctgaaacactttgttgtggcgaaagtcattgatccagtgcagcgccggctggcggccgagcatgcggctggcgtgcaggatcagatagcgcgccactcgtccgagcaacagagcgatcaccaataacaccgtcagcgcgagccccgcctgcaaaagcggatgctgttcgagggtgccccagaggtcttgggcgttgagccagagctgtttgatatccataagtgaaacgattcttctgtaagacgcgatggccgattagagcatttaagacgccaggtattacgtttggagacaaatcaggcaacaaaaaaaccactgattgccgccgtttgcataaagaaactcggcctgagcgctcgaaaccggtaacctatgcagctgtttttttgcatatcttcgaggtagcacccgtgttttcccaattcgccctgcacgaacgcctgcttaaagctgtggccgagctgaaatttgtcgagccaacgcctgtgcaagccgcggccatcccgctggcgctccaagggcgtgatctgcgggtgacggcgcaaaccggtagcggcaaaaccgccgctttcgttctgccgatcctcaatcgcctgatcggcccggccaaggttcgcgtcagcatcaagacgctgatcctgctgccgacccgcgaactggcccaacagacgctgaaggaagttgagcgcttttcgcagttcactttcatcaagtccggcctgatcaccggcggtgaagacttcaaggtccaggccgcgatgctgcgcaaagtgccggacattctcatcggcaccccgggccggatgatcgagcaactcaacgccggcaacctcgacctgaaagaagtcgaagtgctggtactcgacgaagccgaccgcatgctcgacatgggttttgccgaagacgtgcagcgtctggtcgacgaatgcccgaaccgtcagcaaaccatgctgttctccgccaccaccggtggttccggtctgcgcgacatgatcggcaaggtgctgaacaaccctgagcacttgcagctcaacgcggtcagccagctgaactcgaccacccgtcagcaaatcatcaccgccgaccacaatcagcataaagagcagattgtgaactggctgctggccaacgagacttatcagaaggccatcgtcttcaccaacacccgcgccatggccgaccgcatctacggccgcctcgtggctcaggaatacaaagcgttcgtgttgcacggtgagaaagaccagaaggatcgcaaactggcgatcgaccgtctgaagcagggcggcgtgaagattctggttgccaccgacgttgcggcccgtggcctggacgtcgatggtctggatctggtgatcaacttcgacatgccacgcagcggcgacgaatacgtgcaccgcatcggccgtactggccgcgccggtaacgatggtctggcgatctcgctgatctgccacggcgactggaacctgatgtcgagcatcgagcgctacctgaagcagagcttcgagcgccgcaccatcaaggaagtcaaaggcacctacggcggaccgaaaaaggtcaaggcctcgggcaaggccgtcggcgtgaagaagaaaaagaccgacgccaagggcgacaagaagaaaaccgccgcgaagacgccgaccaagcgcaagagcgccaaccgtccgaagccggattcgttggtgagcagcgacggcatggccccgctgaagcgccgcaagccagcagagcctgcggctgagtaaagcggttcaggcgtgcatgaaaaacccggacaatgtccgggttttttttcgtccatcagttgccgagctggccactggtgtcggcgtcaaagcgccgtttggcttgatccgctgccggtttcaatgcgccgagaagtgttgcttcgctgtacaacccggtaaccgccaactccttgggcgtcggctcgatggggatcagcacgtcctcaccgtcagcatgcagccagatcgctacaacgtgcagggctgagacaaacagcacacgcaactcgacgctcttgccttgaagttgcggcgcttgttctgccagtttcagcgcactcaccgtagcagcggcgtgatcgccgtgattcagcgaggcgaattcgacatgcccgcgcacctcggccaattgcacatcggcaatcgtcacgccgtcggcaaagaccaggtaatgccagtcgccgattcgtgcgtctttcaggcctttgccttggctcaggtcatccaggctgagcgaatagccacggtaggcttcgctgaggctgattttcgccggtacagcgttggcgaactggcgactggcgccaaaacccggggtttgcagcgcggcttgcagggccgggcgcaaggtctgtacgccgttggaaggcgcctttggataagtcagttgcatgatgtcgccctcctagttttttaccgtgaagtaagtgtgagtccagttgccgccgccattgtaggcacggggaaaggcattcagcgcacgggtcgaataaccgtagatcgagtccgcgaccagcacgtaatcgccgttggtgccgtagatcgtcaggaaatgcgcaccgccgccgtaccaggcacagcgcaggccgaccgggcggcccatgctgatctggttctggatcgccgacatctgcagcgaaccctgattcataccgttgtagctgcgggtggtttgcagggccgagtccagatagccgtagacgttgcacggccctggctgattgcagcagttgcggtcgagctgagtgctggccacaccgcactgagtccagttgccggtgccgtaatagttgccgaccgaggcggaaacagcggcccagcaccagttggtctgggtctgttgctgcatgctgaagttgaggctgccagcggcaaaagcgctggcgtgttctgccgcttcgacttcgaccagttgtgggtcgagcagatgaccgatgaggcaccttggcagtgattcgctggtatagggtcttgcttcagtggttaacattttttcaatcctccatgaatgaaaacaagcgtcccgcttgtaagggtgttgccgagcgatcggcgcttgagggtcgccatctccgatggcggttgccgatctccttgctcgatgtaaccgtagacgggttatgcgtttatgcaaataaataaatgcatttgtgcattttcatgagcaaaagatcgcagcctgcggcagctcctacggtggtcggcgtaggagctgccgcaggctgcgaacttttgtttttaactttcggctttcttctcggccgtaccgagttctttcaaccgctgatcaatcaactgacacttgtccggcagatccgcactggccgtacccagatccatcttctgcaactcggcattgatctccttggccttggccggattctgttcggtgagcttggcaacttccttggccagttgttcgcgtttggcggtggcctcttccggcgtacaggcccagacgggcaaggcgcaggcaagagtggcggcgagagtgagcttgatcagggttttcatggggagggcctcagttccggttaaggcgggttaaccggttgaggcctttttgctgcgaaaagttcagtcgccatggcagcagctggatcgggtttgcccgtcatatcgatcatgatgccgaacccattccatgatctcgtcttcattcctgcccttgggcgtgaggtcgagatagttgtaggcaccgaccagcatgtcgagaccacgtgcatacgttgaataggtgtggaagatgtcgccatttgcgtcgcgataaaacacgctcagcccgggcatttcttcctcggcgctgtcagttttttcgtagttgtaggtagccgttcccgccgcgacatcatcggcacgggcacacacgccgaagtcatagttgaagtcgcagccttctgaagacacccagtcgaatttccagcccatccgttgtttgaacgcctgaaactcgttgaatggcgcatgggacacagccaccagcgcaatgtcgtgatgcgccagatgctggttggcgccatcgatatggtcactgaggaaagagcagccctgacagccttcctcccaatccttggcaaacatgaagtggtaaacgatcaactggctgtgtttaccgaataggtcggcgagtttcagttcgccgttcgggccttgaaaatggtaatccttgtcgactttcagccatggcagcgcacgacgttctgcgctgaggcggtcgcgttccttggtgaaggctttctcgtgggccagatgttgcttacgggcggcgagccattcttcgcgcgataccaccggatgattctcaacgttcatgatgatttctcctgcggggttgaaaccgtctgtttcagactagtcgtttaaccctgcgggaaatcgacagaccgccggtcggtggtcgcgcaacatgcggctgaacggctgcgagcggctccggtcacaacctatgaacgcgccataaatcacgcgcaccggaggttgtatcaggatgacgacttataactgggatttgattgaacgcttgctgcatgaagtgcaaaacagcgccggccacagttttgcccctcgggcttacgccgaagactatgcggcggagaaagccagtgcgggcgagccgatcgagaaccttgatcatctgaaaacgctggcttgcgactatgaacgcttgctgttgttgcgtggctacatcgcaccgcgtccggatgaagagggcagcaccggcaacaattttgtgctgacgcctcgcggttccagcctgttgagcctgatagacagcagcattcccggcaatgatcatccgcgtgaggtgctggatgaacaggacgatccgctggccgaggcgacgtttgatgaagtggcttcgaaggcccagatcgcctgaggctctgaaagcagaagatcgcagccttcggcagctcctacaccgatctctgtaggagctgccgaaggctgcgatctttgtttctagttctgcttcgcggctttgaggcatttgaggtcgttgaagtctttacgcacaccctcgatcttcttcaacaaccgctggcgctgttgcggcgagctctcagccatcagatcaaccgccagcgagcgtccctgcgcctcagtatcggcgaaggccttgcggtaatccgctgtccataaactctcgcgattgaccagaagggtctcgattctctgtgggaattcgggacttttgcgttgcgctacagccgcactgaactgcttctgccaatgggcccggttggcaatccattgggtgtactgatcgcccagggcggtcgaccacgccatgacccgctgctcttgtgtggcgctcaatggcccaagccaatcgttgaggcgcttgaccatgcgcgcgccacgctcggcaatctgttgatcaagcggtggtttcaggtactcctgctgacgcttgcgcagatccttggcaaacgcctcattcatctcggccacttgcttgtcatccagaccttgcaataattcgatggccgaaggcgtgatttccttcgccgtttgcgcaatcgcttgcttggcttcgacggtgcgcgcctgtagcgcggcatcggtgacctgattggtttcgaccatggtctgcaagcgatccagccagtccagatagcccggtaattgcgtggtgcaatgccagctcaggtgatccttgagccgttcgttgaaccagtctttttgctcgccgttcatgtccaggtagtcgccgagcgtccacggaatgatcacgtcgagattgcgataagccaggccgactcggctgcaggcgccgagggcgagggtgaagaccaacagtgcggcaatgtgtttgaaccagcgagacatgagcgaatccttgcatggcctggcttcgggagtctgattcttatgtgatgcaggatgcgcgcggcagttcagccgatcaatagaatgcgcgttcggccttgagggtgacgagaccgtcgcactggctgttgtgcccggagtaggccgagcaatcgctgccgctgaggctggagttgctgtagatcaggtcaaggtcgacacccatgaacggccgcgacagttgtactgaccaatcggtgaaactgctgacataaccaccgtccacggccaccggtttgttcaattggtgggtggtgtatttcatgctgacgccgatgccgaacggctgattgccgccaaggtcggcaaacaaggtgttgttctgcttatccgggtcgttgctcaatgccacgccgaaacgactgccaagcagggtcaggccaccgaacagctcctggctgtcgagggtttccacgctgggatagctgtagtggatcatgccgacttcgtagccgagggtttgatcgaagggttgtttaaaaccgacgtaggaatcgatttcgagattcttgcccggcgtgatgcccatgctcggtgcgtattggccgacatagaggccgctgtcgtggctcagatcgaggccgccatgaaacgacccggccgccgagggtttgaccaggccttgggccatgctgcgcgttggcgtggtgccgagcttgaggtcgaagtcgcccatttcacgctgaaaaacctgcgcgtgcgcggttggaccggccagcaggccaacgagtaataaacaggatgttttgcgcatgcgtcactccatgaacagcgagtgcaggacggcgggcctgctgaaacgcttgatccagacgcgtgcaaggataccggcgaatgttcggcattgatggccgttcgtcgattttcagaatttttggtatttgatttgtttgaagcggggagggtgtttcgcggtgccagtccaggcgcttcgaagctcaaagcgcctctggacgggggtaaaaccgggtgttacttcttgcccaggctgatctgcttggacgggccgaacgtctggccactgacgcctttggcaatttgctggatctcgccgccggacttgaggaacgctgcgatctgatcgttgatcgattcgctggtttcaacggctggagctggctttgctttgctggtggatgcttttacacgcatggcggccattaacctgtagaaaagtaactcggccaggcatcgtacaggaataacttgacaattgcttggtaaatatccccgggaataacctagcgctgcactgcagtatgctcgattcaatattcgaaatacttggctaacctgctgttttaaataagaagattaatgaatttcggcggtgtggcgatatgccgcgagggcgcacagccgactgacgagtggcacccggtgcggcgcagatcaaggaaaatcaaggcgttgcgcagaattcccggcaaccgccgatctaccgcccgacgtcgcaggcaaaaacgggtagaatgccgcccacgcaatgagggttctggaaatggctttagtcgggcgttacaacagtttgcaagtggttaaacacactaacttcggtttatatctggacggcggtgccgatggcgagattcttttgcccaaccgttatatccctaaagatattcccagcgaagatgaagactggctcaacgtatttgtttatctggacagcgaagacaaacttctcgctaccactgaaaaaccaaaagttcaggtcggtgaatttgccagcctgaaagttgttgaagtcaacagcatcggcgtgttcctcgattggggtttgccgaaagacctgttgctgccgtactccgaagaaaaacggcagatgactgccggtgaatattgcgtggtgcacgtctacctcgacaagcacacccgccgcatcaccgccactgcgcgtctggatcgctacctcgacaagaccccggcgaactacagcctgggtcaggaagttgatctgctggttgccgaagccactgacatgggcttcaaggcgatcatcaacaacaagcattggggtttgatccacaagaacgaaatcttcaagttcatgcgcgccggcatgagcgagaagggctacatcaaggaagtgcgcgccgacggcaaaattgccctgagcctgcaaccggttggccaggaagcggccagcagcctcaactcgaagatcctcgccaagttgcgtgataacagcggcacgctgccggtcagcgacaagagcgatccggcgctgatcagcagcctgttcggcgtcagcaaaggcaacttcaagaaggccatcggtgcgctgtacaaggaaggcaagatcgttatccacgccgatcgcattgaactaacctgagccaccgctggccccatgtaggagctgccgcaggctgtgatctgttgatcttgtcttttaaaaacaaagtcaaaagatcgcagcctgcggcagctcctacatgagggcgggtgttatgaagaaaactctggttgcctatgttgcgacgctgattgcgtttctgctgctcgacggcatctggctcggcctgttgatggcgccgacctatcgcgaactgctcggtccgctgatgctcgataaaccgctgctggttccggcagcggttttttattgcctgtatgttttcggttgtgtggtgtttgtggtgctgccggccgtgacatggcaatgggcggcgaagcggggcgcgttgctgggcctggtggcgtatggcacgtacgacctgaccaattgggcgacgttgcgtggctggtcggtgcaggtgacgctgatggattgggcgtggggcacgtttgccacggcggtcgcctgtgctgtcgggtttttgctggcgaggcggtttgctggagctgatcgctaacccgcgtcgattgaactgacgccatcgcgagcaggctcactcctaccggggaacgcgatcaactgtaggagcgagcctgctcgcgattggcggcgcagccgacagccattcagcgctgacgccactgaagcacaaaatgtcttttccagacggctttttccgcccgactgattgataatcctcgacactgatttctgaccattggatggcctgccatgttgtgtgtgttcgaggtgttgcggtgagtagcgagcggcgcaatgccgaccgttttgccttgcaggtgatgatcggcttgtgcctgatctggggcgtgcagcaagtaatgatcaagtgggccgcgccagacattgcacccgtgatgcaagcggcggcgcgctcggggatttccgcactgctggtcggcttgctgatctgctggaggggcggctgggaccaggtcggcgttacttggcgcggcggtttgctggccggtgcgctgttcggtctggagtttttcttcattgctgaaggtttgcaactgaccaccgccgcgcacatgtcggtcttcctctacaccgcgccgatttttaccgcgttgggcgtgcattttcttttggccagcgagcgcctgcggccgttgcagtggctggggatcctactggcgttcatcggtatcgcaatcgccttcgccggcggtgtgtcgtgggacaacctcgaccggcgcatgctgctcggcgatgccttcggcatattggccggcgcctgttggggggccaccaccgtggtcgttcgtgcctcgcgactgtcggaagccccggtgacattgaccctgttctatcaattgatggtcggctttgtcggcctgctgttgatcgccttgttcagtggtcagatcactcatgtcagcctgacgcccgtagcggtggccagcgtgctgttccagggcctggtggtgtcgttcttcagctacctgatctggttctggctgctgcgccgttatctggccgccaacctggcggtgttctcgttcatgacgccgctgttcggcgtcaccttcggcgtgattctgttgggcgaacaactgagcgtgaatttcgtcatcggcgccgtgctggtgttgctcggcatcacctttgtcagcgccgagcagtggctgcgcaggcgtttgcgccaagcgctgggccagcgttagtcgattgcatcgccaggccgccggcgatcagcaaaccgctgccggcgatcaccagcgccggttgcaggccaccgctgaaatggctgctcaatgctgccagtaatgggccgctgagctggccgacggcaaagcacgcggtcagcagtccggcgttgcgctgcgttgcgtggggcgcgatttcccgtgagcgttgcatgaccaattgcatgcaggcgaggaacggcgtaccacacagaatgacccccagcgccagaccgaggccgctgctcagcaggcaggcgaatactcccgccgcttgcagccataacgttgccatcaaccaatgccgggtggtcgcggggtcgtgacgacgcaggctcaccagcaacacgccgagcgcggcggccagaccaaagcacggccagaacagatccgcctgccactgtccgtggaactgtgcgttggccatttgcgagagaaacgtcgcggggatgatgtagccgatgccatacagggcataaatggtcgccagacggccgatgccttgagtcggtgggttggcgtcagtcacaaccaccggtaagccaccgaccggctgcggcaaaatgcgccagacgccgagcatcatcaccagtgccgcagcggcgtaaatcagccacagcgtcgccgaggtctgattgagcaggtgggagaccagcgccaacaaccccgtcagaaaaatccccagcccaggcccggcaaataccagcgcgcccaaacgcggacgacccgctgccgccgccagtggctgacttaaagacgtgatcatcaccagcacccaggcactcgccaccccggtgccgaagcgcagcaccaagtgcgaccaaaagcccgtggcccaaaacgacgccagcgtcagcaaaacacacagccacaagccgccgtgcaggcgtcgctgcacctgctgcgggcgatgcgcaaacatcgcatccaccgcgcccagcaagtaaccgaggtagttggccgcagcgatcagaccggcggccgtcaggtcgaactgaccttcgctgagcaggtgcggcatttgtggcgtgagggcgaaacgcccgatgcccatggccatcatcagggctacgaaacaagcggataagcgaatcaggggcgacatggtcgggattcctatgaacgatcaatgaccgtcaggctaggactgattgactttctttaaaattgaataatagtgagtaacttgttctgttatggagaaagcttgtggagttcagccaattgcggatctttcaggccgttgccgaggaaggttcgatcacccgcgccgccgaacgcttgcaccgggtgccttccaatctgtcgacgcggcttaaacagctggaagaacagttgggtgtcgaacttttcgtccgtgagcgtcagcgtttgcagctttcgcctgcgggaaaagtcctgctggactacaccggcaagttgtttgcgttacgcgatcaggccagtgcggcggtgatgggcgggcagccggcgggggattttgtcctcggcaccatgtacagcacggcggcgatccatttaccggcgttgctcgcgcgttatcacaagcaatacccggcggtgaacctgcaggtgcagtcggcgccgagtggcgagttgctcgaaggtctgcttaccggtcgactcgatgcggcgctggtcgatggcccgctggaactggccggactcgacggtgtgccgttgtgtgaagagcggctggtgctgattaccgaaaccgatcatccgcccgtgcgcagtgccaaggatgtcgaagggcgttcggtgttcaccttccgtcagggctgttcctatcgcatgcgcctggaggcctggtacgcccactatcacgcagcgatgggccgggcgatggagatcgagtcgtatcagggcatgctcgcctgcgtgatcgccggcagcggcgtggcgttgatggcggagtcgatgcttgccagtctgccgggtcgcgagagcgtcgcggcgcacccgttggccgagccattcgtgggtgcgacaacgtggctcatgtggcgcaaaggcatggtcggcgccaacctcaatgcctgggtcgaggtgcagcaagctgtctatcctgcggctcagatcgaaacccgcgaaacagcctgaaccaatgccggcgaattctgttcaattcagtaacagatcattgcggatttggccgagcattgcgtaggacttcggactattatcagtgcgaagcggcctcagaattccggccgctcagcaccaccctgaagggggcatgacgatgaaagagaaaattcaaaactggctacacgacttgggtgttgccctcggcttgatcgaaccgcctctgcagcctgtcccgatccgcaccgatgacgagcagcgtcgccgtcaacaacggcgccggtaacgccaccgatccgagatcacaggattcaagatcaagagatcgcagcctgcggcagctcctgcacgaatcaatgcaggagctgccgaaggctgcgatcttttgctttcagtgccggccaatctcaagcaagaaccggctcaagtcattcgcagtcttcgcggtcttgagcatgcggtcttcctcggcggtgaacgccgtcagtccgaattcatcttccagatgaaagatcaaatcctcgatgtcggctttctccagccccagttgcaccaggctggtgttgtcgttgaattcgcgggtttccagcaaacgctggatgtatcggtgcacggcggcacgcacggcagctcttctcatggcagatttttctgatggttgttctgcttgagtgaagcaggcctcaggcgtggccgcgcaaccattggtcaatcatcgagcgcaaatgctcgccggaaaaactgccgaaatgcccgccatgcaccgtgcgaatcggcaacgcctgcaaacgtcgcagactgctggcgtaatcctcaagattggagtggtaggcgtcttcgatcagcggcccgtcgtagatgatgtcgccgctgaacagggtttcagtggccgcttcatacaggctgatgccgcccggcgaatgccccggtgtgtgcagcacttgcagcgtgcgattgcccagatccagcacatcgccgtcctcgacaaacccggtggccggcgcggctttgacccggtattcggcgtagcacaacgggcagtccgggtgcgcctcgaacatgtcatcgccaacgaatgcgcggctcagatcattctcgccatccggcgccgccagaatgtccgcctcggccgggtgcaccagccgttcagcaaattcatgatgcccggcgatatggtcgaaatggcaatggctggccaccgccatcaatggccgctcggtgatccatggcaactgctcgcgcaggctgaccagccccgaaccgctatccagcaacaggtctttgtcgcggccttgcacatgccacaggttgcagcggtagaacggtcgaatatacggctcatggatcagccgaatgccatcgctcaagtgctgcacttcaaaccactgatcgcgcgaaacgatcttcatattcacttttctccagacgaaaaaaacgggtgtggcaagtgggcgtgtcctcccttatttcctgcaccgcgccggatctgatgtcgtgcagggcaaggcgcgaggagcgtagtttggtttttccaaataagctccgagcaacgcagccctgcacgacatcagctccggccctccgggttgtgcctaaaagcgagccaggctgcgttgcagtccttggcaaggaacaacccttacctacggactgcgccttgcctggctcgcttttaggcgcaacgcggtgcaggaaataagggaggacacgcccgtgccacacccgtcgaagaaagcatcaagtcgttacatcaagcttagatcgcactcgccacggttgccgggcgaggggagaacaggctgacgaccacaaaactcaccagacctgcgccgaggctgtagtagatcggcgtgttggcatccagaccgtccttgaacatgaacagcagcgaagtggcgaaacccagacccatggaagcaatggcgccggcggtggtcgcgcgtttccagaaaatcgcgccgatcagcgggatcagcatgccgcccaccaacaggttgtaagcgagggtcagggcgctgatcacgtcattcaccaccagcgcgatacccagtacaacgatgccggtcagcagagtgaacagacggttgatgcccaggctcgactgtttgccgccacgcagtttcggcagcagatcttcagtcagtgtggtggcagcggcgaggagaccggcgctggcggtggacatcattgccgccagtgccgcagcgatcaccagaccacggatgccgtccggcagcgatagtttgacgatggcggcgaaggcgttgttgacgttgtccagatccgggatcagcacgtgtgcagccatgccgatcagcgcgcaagccaggccgtagaggatgcagtagatacccgcgatgctgccggcgtattgcgcgactttggcggtcttgacggtgaacacccgttgccagatgtcctgaccgatcaggatgccgaagaagtagatcatgaagtaggtgatgatcgtgtcccagccgatggtggtgaagctgaaggcggtcgccggcagtttcagcaccagttcgtcccaaccgccgacgcggtacaggcagatcggcaacagaatgaacatcaggcccacggttttgatgatgaactggacgatgtcggtcagggtcagcgaccacatgccgccgatcgccgagtagatcaccacgacgccaccaccgacgagtaccgaaacccagaatggcaggtcaaacagcacttgcaggacggtgccgatggcgaggatcgaggtcacgccgatcatcagcgcgtaggccagcatgattgctgcgctggccgagcgggccatcgggttgtagcgtttttcgaggacctgggtaacggtgtagatcttcagtttcagcagcggtttggcgaggaacaggttcagcgcaacgatgccgcaacccaatgccgcgcacagccagaaaccggagatgccgtgcacgtagcccaggcgtacggtgccgacggtggacgcaccaccgagtacggtcgcggccatggtgcccatgtacaggcttgggccgaggttacggccggcaacgagaaagtcctcgttggtcttggccttgcgcatgccgaagtagccgagcaagagcatgccggcggcgtagatgaggacgacgaataaatccaaagccatgatggcgtgtctccgattgtcttttttatggtgaaacaaatttggttcagcaatgctgcccactgtgggagcgagcctgctccgggcggcgatccgacgaaggcgtcagcacattcaacaaagatgtgactgacagatcgctttcgcgagcaggctcgctcctacagggatctgcgtcaggcggtctggcgcagttcaggtttttccaggatttggctgcgtgcatccttcgggccgaacacttcgcgcggttccgggaacaggcttagcagcgtcaggtacaccaccgaggccaggccgagggtcaccggcaagctgatgtcgatgccgccggccatttcacccagcgggccaacgaattgccccggcagattgacgaagcacaaaccgaccaccgcgctcgggatccatgcgcccagaccacgccagttccagccgtggctgaaccagtagcgtccgccctgttcgccacgggtgaatacttgcaggtcatccgggcaatagaagccgcgacgcaccaagaggccgatgatcatgatcaccatccatggcgtggtgcaggtgatgatcagcacggcgaaagtcgacacgctctgcaccaggttcgccgcaaagcggccgatgaagatgaaggcaatcgacagcacgccgatcagtagcgtcgctttcactcgcgagagaacacgcgggaacacgctggacatgtccagcccggtgccatacagcgaggtagtgccggtggacatgccgccgatcactgcgatcaggcacaccggcaggaagaaccagctcggcgataccgccagcaaaccgccgacatagttgttcgccgctatatagtccggcgccttgatcgcgacgatggtcgcggtggtcaggccgaacaggaacgggatgaacgtggcaatctgcgacagcaccaccgccgccatgatccgttgcttggaggtgtcacgcgggatgtagcgcgaccagtcaccgaggaacgcaccgaaggaaatcgggttgctcatcgccactagcgcggcgccgatgaacgcggcccagaagcccggctgaccgaggctgacggtgccagcgtaatgcgcgtcgaaaggaccggcgaaggcaaagatgcccagcaggaataacaggctggcgctccacaccgcgatcttgttcacccacagcagaaagcggaagccgtagatgcacacggtcagcaccaggatcgcgaacagaccgtaggccaggcccagagtcaggtcggtttccggcaagccgatcaggcgtttcgcaccaccgatcagcgcatcccccgaactccacaccgagagcgagaaaaacgcgatggcggtcaacagcgacaggaacgaaccgacgatccgcccgtgcacgccgaagtgcgcaccggacgacacggcattgttggtgccgttgagcgggccgaacaggcccatcggtgcgaggatcagcgagccgagcagcacgcccagcacaatcgcccagacgccggcctgaaaagacagaccgaacagcaccgggaaactgccgagcacggcggtagcaaaggtattcgaaccaccgaagatcatccggaacaagtccgtcgggcctgcgctgcgttcgtggtccgggatctgttcgaccccgtgggtttcaatctgcgtaaggctttggtcgttgttgttgttattcatgatctgctccgatcataaaggcgcgcctcatcgtgcgtgaggcgtcacctgttttggctaaggggatggcagcccttccggcattgcggacaaatgttcgtggcaggccagccaatggccttgttgttctaggctcgacgcttgtttcttgaaaacaatcgtctcgcgctcctggctgaagtgttgctccccttgcatgcgcagctcggtggccacgtcatggatgaaaatcgccacgtcaccctgcaggctgacaaaggcgttgctcgaggtgcacgcaagcacctcgaagccatcctcggcgcgccagctgtcccacaaggcctgataggcatcgcgcgacagcagcggctgttcgagggtgtagaagacgaaactcgcatcggcgctgaacgcgccgaagtaagcttcgcgatcgttacgggcgaaggcggccaccagatcggcagccgcttgcaaaacctgatcacgttcgttcatgacccgaccctcagcgatggaccacgccaggcagtacgcagagcatttcgtacagcaggttggcggccagcagcgaggtgttgccggtggtgtcataagcgggcgagacttctaccagatcgcaaccgatcaggtcgaggccttggcagccacggacgatttcaatcgcctgaatggtcgtcagaccaccgatttccggggtgccggtgccaggcgcccaggccgggtcgataccgtcgatgtcgaaactcaggtacaccggaccgccgccgactttctcgcgcacttcggccatcagtggcgccagcgacttgtgccagcactcttcggcttgtacgacgcggaagccctgatcgcggctccagttgaagtcatcagcggtgtagccctgcgcgcgcagaccgatttgcaccacgcggtcgcagtccagcagaccttcttcgacggcgcgacggaaggtcgtaccgtgggcgatcttctcaccaaacatgtgatcgttgacgtcagcgtgggcatcgatgtgcaccagaccgaccttgccgtgctttttatgaatcgcccgcaggatcggcagggtgatggtgtggtcgccgcccagggtcatcgggatcacgttgtgctcgaggatgttgtcgtaggcttcttcgatgatgcgcacggcgtcgagcagattgaaggtgttgatcgccacgtcaccgatgtcggccaccgacagcgagtcgaacggcgcagcgccagtggccatgttgtacgggcggatcatcaccgattcggtgcggatgtcgcgtggcccgaagcgggtgccggggcgcagcgaagtaccgatgtccagtggcacgccaacaaaggcagcgtccaggccggcagcggtcggtacatgggggagtcggagcatggtggcgatgccgccgaagcgcggcatttcgttgccgcccagtggttggtgaagaatcttgtccacgggtagggcctcatcgtctttgttttatttatgtcggcgcaccgttgagcaaggggtcggacgccgctgtggggccgatgatgcgaaatgtagtgaggggaaagaatcgctacgggcaaaaacttagttcagatttttctaaactaatggcgaggctgggattagactttggcgggttcaagattgtgatcggctggggattgctgccctcaccccagccctctcccggagggagagggagctgatctccattgctttttaattttgagttcgactcgatattgcaggtcggcgtaaatcctcataacagctcggtaggctccctctccctcggggagagggctggggtgaggggcttttcccaccgacacacagttgcaaagcccggagcagacatggccaacgctttacccgacctgaaactgttgcgcatcttcgtcagcgtcgtccgtcatcagggtttcgccaacgcgcagcaggaactcaacctgtcgacctcggcgatcagcacctacatgagccagctcgaagccgcgctcggcctggtgctgtgccatcgcgggcgcggcgggttcagcctgaccagcaagggtgagctgttccatcaggaaaccctgcgtctgctcgccgaactcgaaggttttgagcaatacgccgccgcgctcaagggcgaactgcgcggcacgctcaacctcggcgtgatcgactccaccgtcagcgacaaggccctgccattcgccgaggccatcggcgcctacagtcaggaacacccggcggtgcatctgcatttgtcggtgatgagcccctacgaattgcaactcggcgtgcaggacaaccgcctcgacctggccatcggtgcgttttccacgcgcatgagcggtctggtctacatgccgctgtaccgcgagcagcactggttgtattgcagcagccggcatccgttgttcaacgagcggcggattcccgagcaggtcatcactcagcaacgcatggtcggtcgtggttactggagtcaggcggaattggcccggcacggtttcaaacacagcgccgcgaccgtggaaagtatggaagcgcaactgattctggtgctgtccggcgcctacatcggttacttgccggagcactacgcgcaggcctgggccgacaagggcgacctgcgcgtattgctgccggcgacgttcggttatcaggcaccgttttcaatgatcatgcgccggggccgtagtcgcgaaccgctgattcagacgttccgtgatctgcttaaagctcagttgaatcaggcgtaaacaacatgtccagacctcaatgcccgcgctgcctgcgtccacaaacccattgcctgtgcccgctgattccgagcctcgacagccgcacgcgggtgttgctgttgcagcatccgagtgaagttaatcatgcgttgaataccgcgcggttggcggcgttggggttgagcaatgccgagctgattgtcggtgaggtgttcgaggatttgccgacgctgttgaaccggccggggtatcaggcgcggttgttgtttccggctgatgacgcgcagccgatgcaggcttacggcgagtctgatgaaccactgttgctggtggtgccggacggcacatggcgcaaggcgcgcaagatgctgcacctcaatccgctgctggcggcgttgccacgggtgacgctggccgagggcggggtgtcgcgctatcgcttgcgcaaggcaccggggccgggggcgctgtcaacgattgaagcgattgtgcaggcgttgcaagtgttggaggccccggcgtcattcgagccgttgctcaagccgttcgaggcgttgatcgaggggcagattgcggcgatgggggaggagacctttcagcgtaatcatgccgaaagataattgtcgtttggactggcgctatcgcgagcaggctcactcctacagggggaacacattccaaatgtaggagtgagcctgctcgcgatagcaattgttcagtcaacgcaggttacggcgagatttaccgttcgcgcatcgcctcggtccgcgctttcagcaccggtttcaacagataatccaagacactcttctccccggtaataatgtccaccgtcgccaccatccccgggatgatcaacaacggtttcacatccccgcccaaatggtttttatcggtgcgcacctgaatcagataaaagctgttgcccttgtcatcggtaatcgtgtcggcgccgatcaactcaagcttggcgctcaacccgccgtaaatcgtgtagtcataggcactgaacttgaccatggctttctggcccggatgcaggaacgccacatcctgcgggcgcactttggcttcgatcagcaggttgtcttccagcggtacgatttcaaccatgtcgctgcccggttgaaccacgccaccgatggtgttgaccttcaattgtttgatcaccccatgcaccggtgaggtcaccgtcgtgcgggtgacgcggtcgtcgatggcgatgctggtcgcggtgattttcgacagatcggtgcgtttctcattcagctctttcgcggcttccgagcggaaggtctgttccgactcgtcgatcttgctgcggatctcggcaatcgccgattcagcgcggggaatggccagcgttgtcgcgttcaacgagccacggatttccactgcgctacgtttcagacgcagaatttccacgggcgagaccgcgccggtttttaccagcggttcggacatgttcatctcttgctgcagcaacgccagactggaactgaactggccctgcttggagcgaaattcggcgagttcctgagtcttctgccgcagttgttcgctcaacgtacgctgctcgctggccagccggcgctggcgttgttcatacagcgaacgctcgtcttcggcgacttgcggtgccttggcgatcacctcatcagagagcttgaacggccggccctcggcctccgccgacaaccgttcgacctgcgcggtcagcgcatagcgatcggcctcgctctcgcccttgttcgagcgaaagcgcgtgtcatccagacgcagcagggtgtcgcccttattgaccatttgcccttcacgcacaaagatttcggtaacgatcccgccctcaaggttctggatcacctgcaccttgctcgacggaatcgccttgccttcgcccatggtcacttcttcgagcacggcgaacttggcccagaccaccgcgctgatcagcagcgccgccgccagccacacggtgatccgcgaccagcgcggcgaatcctgcagcgaagcaccggcggtttccggcatgaattccgcttcggcgcttttaccgaaactgtcgaagtagccgcgatctttgctatcggaggaagcagacatggggcaactcctagaccgccgccgagccgacacggcccttgcgcagtgcatcgatgaccgcttctttcggaccgtcggcgacgacccggccgttgtccagcaccagcaaccggtccaccagactcagcatcgaagtgcggtgggtcaccagcagtaaggttttgccttgcacccagccatgcagtttctgccgcagcaagtcttcactgctgttgtccatggcgctggtgggttcgtcgagcagcatgatcggcggatcaagcaatagcgaacgcgccagcaacacggcctggcgctggccgccggagagcaattgtccgcgctcgcccaccggccgatcgaaaccttgcggatgctggcgagcgagttcggtcacgccggtcagttcggccacttcgagcatccgcgaatcgctgatgtaacgtgcgccgagggtcaggttgtcacgcaggctgccggccagcagcggcaggtcgtgggcgacataaccgatctgctggcgcaggtcggcgacatcgagttggcgcaggtcgaggccgtcgagcagcagttggccttcttcgggttcgtagaagcccatgaccaatcgcgccaaggtgcttttgcccgaaccgctgcggccaatgatgccgacccgctcgccgggtttcaggctgaaggtgacgttgctcagcgccggcgcattctggccgttgtaatggaaggtcacgccgctgacgtccagcgcgccttgcagttgcgtgcgttccagcggccgctgtttgccgtcgcgttcctgcggcagagccatcagcgcatcagtgcttttcatggtcagttgcgcttgctgatagcgcgtgatcagcccggcgatctgcccaagcggcgcgagcacacggctgccgagcatgtaactggcgaccagcgcaccgacgctgagattgccggcgatgatgctgtagacccccgcgacaatcgtcgccatcccggagaattgttgaatgaacaacgtgccgttggtggccagcgccgacagattgcgcgcatggctgtcgaggcgggtgagggcgccgtgggtgctttcccatttgtgctggcgctcgctttcggcgctgcaagccttgagggtttccaggccaccgagggtttcgatcagcaccgcttggcgttcggcaccgaggctcaggctcttttgcacggtgtcacgcaggcgcacttgaatgatcatcgcgaagacgatggtgatcggaaacgcgagtagcggaatcaccaccagccagccgccgagcaaaccgatgaccaccagcatcaacaccacgaagggcaggtcgatcaggctggtcagcgtcactgccgtgagaaattcgcgcaggccctgaaagtcatgaatgctctgcgcaaaaccgccgatggtcgccggccgcgccttcatcgacatgccagtgatgcgttcgaataaagtcgcggaaaggatcacatcggttttcttgccggcagtgtcgagcaagtgtgcacgcaccacccgcaacaccagctcgaaaccggtgccgatcagcagcccgatcgacagcacccacaaggtcgaagtggcctgattcggtaccacgcggtcgtaggtctgcatgacgaacagcggcaccatcaggcctaaaaggttgatcaggaaactcgcgagaatcgcatcgctgtagagccattttgacagtttcaacgtgtcgcgaaaccacgcatgcacccgtggcaccaacggcgagcgcaggtcttcgagttcgtggcgcggacgggcgaacaaggcctggccgctatagtgctcggtgagttcttcgcggctgatccattgctcgccgccatcggcttcgctgggcaggatcagcgctttgccgtcatcgccgaaacgccgcaacacggcggtgcggccatcgttgagcagcaacaggatcggcaggttgagcggtgaaatatctttcagatcgcggcgcaagatgcgcgcctgcaacccggcccgggcagcggcgcgcggcagcaaatccaggctcaggcgttgtttgttcaagggcagcccggcgctgaggctggcccgactgacgatggcgccatgcagtttgcagaggatcaacagaccgtcgagtaacggatcatcgaagctcagccgcggatcaatcccggagtggccgggttccatgctggtcatattgatcgcctctgttgatcgggcacgggaatccacacattgatcgttcccacgcagagcgtgggaacgatcaacaggggacttatttcagttcaggcagccgcgcttcgtttttgacctcagtcgcggcaatcgcatcggccggcaacaccacccgttgtttgctcagcaactgacccatgttcgccagcacgcggtacatcgaatattcctcggtgtagcggatttcggtgtagcgacggttggcgttgtagagctcgttttcactgtcgagcaagtcgagcagggtgcgttggcccaagccgaactggtcctgatacgcggcgcgtacgcgtttggtggtttccgcatattcgcgggcggtcggggtctgtttcttcgcgttgaccatggcgttccacgccaggtgaatgttctcgttcaactgacgcagggcgttgttgcggatgtccatcgcctggttgatctggtgcgcatcggaggccagtcgtgccttgtcgctgccgccacggaacaggttgtagttcatcaccacacccacacgccattcgttgtcgtggccttcatcgccctgcacgttgttgttcgcgccgacggcggcttcagcatcgaagcgtggatagaacggcgacttggcgacttcgtactggctctcggccgattgcacgtcagcctgggcggatttcaggtacgggttgttttcgaccatgctctgctgggcttccggcaggctggtcggtaattcgccacgggtcgaggccggggtttccagctcatcgggcatgcgcccgaccacgctgtagaagttcgattcggcgtcggccagatcgacttcggcggtatcgaggttgttctgtgccagcgccttacgggccaccgattgatccgagtcggcggtgctgccgacgccacgctcggtgcgcaggccgatctggtcgttgacccgcaaatgcgcctgcaggttgttcctggccagggtcaccagctcgcgacgcttgagtacttcgaggtagacctcgatggtgcgcagggccaggtcctgtgcggtgccttgcgcgtagtacgcgcgcgaattggacacgcctttggtgcgctcgacttcgttggcagtgttgaagccgtcgaacagcatctgccgcagacgcagctcggactgggtgtaattgaggatttcggtgtggtgatttccgaaggcccgggtgttggtgttgtcgctgtagccacggccatacgcagcattcaagtcgaccgacggatagaagccgcccttggcgactttgacttgttcatctgccgacaggcgggcgtccacgcgcgaagccagttccgggtgagtggcgatggtgctttgaatagcctcggtaaggttcatggcctgggcttgagaagtgcaagccatggccagcaaaaccgcgctgcagaggggggttagaacgcgcatgggtgcatctccctgagtcctgatggtgtgttactgtcgccaaatatttgacgatatttgtaggtctaagcgtttcactcttgtaacaacagagctaagaacatcctagagcgtagctaagaaaaatttttcataaggcttatgccgaaaaaaacttatgcgctttagcaaaaccagcacattgttcagcacgaaagcctttgttttatgcgctttagggagctcagaaaggcttgaggaaagttccactcactttgcgacatacggcgaagtactgctgaaggggagggacgcgtagcggcgaaagagcgacagatttttgtcactcgggtgattcaccaccgttacgtagcgttagtgggcgggctgtttgaatcaggattcgcaagtgcttgatagcgctaggatttctcttcaaacaactcctgcgaaacgaactgtcgagggtgcgagcgtcgcctccgacaacccgattgagccatgggctgcttcgcgaaccagtgctgacggtggtcggcagcggaggatttcacatggcaacgctcatcggtaccgtcacaaaagtcattggtcaggtattcgcgcaggcagccgacggcatcaagcgtccgttggttgagggcgaccgtttatttgcaggcgatcaactgatcaccggcgctgaaggcgcggtggcggtgaaactgcagaacggtcaggagctgaccttgggccgcgacagcagcctgaccatgaccggccagttgctggcggatcaggccgctcatgtgaacgttgcggaggccgtgaccccgagcgaagcgcaactgaccgacgtcgagcaaatccagaaagccattgccgcgggtgatgaccccagcaaaaccgctgaagccacggctgccggccccaatgcccccggcggtgcaccgggagaggcaggtggcggccacagctttgttctgctgactgaagtcggcgggcgtgtagatccgatcatcggcttccccactgccgggttcggcggtattcccgagtttcctgaagagcgtcataacgcggtgatcgacaacggcgacgacaatgccgcgccgatcacgccgccgccaccgctggtggtcaacagtccagtgatcatcgacggcctcgccgtgccgggcggtgaactgaacctcaacgaagccaatctgcctgacggttcggcggccaacccgggagcgctgacgcagagcggcagtttcacggtatcagccccggatggcttgagcagcctgagcattggcggcatcaacgtccttgtcggcggcgtgccggtcggttttccacaatcgatcaccacgcaactgggcaacaccctgaccatcaccggctacaacccggcgacgggcgcggtcagctacagctacaccctcaacggcaatgaaacccacgctgccggcgatggcgccaacagcctcagcgaacagttcaccgtgattgccggcgacaacaatggcgacaccgccaccggcacccttgacgtcaacatcaccgacgacgtgccgcgcgcggtcgacgacaacaatggcacggcttccgagacgttgctgacgttgaccggcaacgtcctgaccaacgatgtgcaaggcgccgaccgcgtgcccaccggccccgatgccgggccgatcacgcctggcactttcaccggtacttacggcacgctggtgctcaacgccaacggcacgtacacctacacgctgaacaccaacgatgccgacttcaaaaacctgcacggcggtggcaacggcaccgagaccttcacctacaccctcactgatgccgatggcgataccagcacggcaaacctcgttctgcagatccacaacaatgatgaccccgtgatcatcaacggcttgaacgtcgagggcggcgagctgacggtctacgaaaaaaacctcactgacggcagcgcaccggattccaccgcgctgacccaaaacggcaccttcaccatcaccgcactggacggcgtcaccacgctgaccgtcggtggcatcgccgtggtcaccaacggtgtcgccgcaggcttcccgcaatccgtgaccacgccgctgggcagtacgctgaccatcaccggtttcaacgccaccacgggcgtggtcagctacagctacaccctggtcgacaacgaagcgcatccaaccgccaacggcgcgaataacctgcctgagcagtttgccgtcaccgtggtcgatgacaacggcagcactgccaacggcacgctcgacgtgaacatcaccgacgacgtgccccaagccgttgatgacagcaatggcacggcgtctgaaacgcaactgacactgaccggcaacgtgctgaccaatgacgtgcaaggcgccgaccgcgtggtgaccaacgaaagtgccgggccgatcaccgccggaacattcaccgggacttacggcacgctggtcctcaacgccaacggcacgtacacctacactttgaacaccaacgacgccgacttcaaaaacctgcacggcggtggcaacggcaccgagacattcacctacaccctcactgatgccgatggcgataccagcacggcaaacctcgtcctgcagatccacaacaacgacgatccggtgatcatcaacggccttgacgtgaatggcggcgaactcaccgtttacgagaaaaatctcacggacggcagcgcaccggattccactgcactgacgcaaaacggcacgttcaccatcaccgcactcgatggcgtaacaacgctgaccgtcggcggcatcgctgtcgtcaccaatggcgtggccgcagggtttccgcaatcggtgaccacgccgctgggcagtacgctgaccatcaccggtttcaacgccaccaccggtgtcgtcagttacagctacacgctggtcgacaacgaagcgcacccgacggccaacggcgcgaacaatctgccagagcaattcgccgttaccgtggtcgatgacaacggcaccacagccaacgccacgctcgatgtgaacatcgtcgacgacatgccgaaggccaacgatgacagcaacggaacagcgtcagaaagccaactgacgctgaccggtaacgtcctgaccaacgacgtgcaaggcgctgatcgcgtaccgaccgggccagtcacggccggcacattcaccggcacttacggcaccctggtgctcaacgccaatggcacctacacctacacgctgaacaccaacgacgccgacttcaaaaacctccacggcggcggcagcggcacggaaaccttcgcctacaccctcaccgactcggacggcgataccagcacggcgaatctggtgctgcagatccacaacaacgacgatccggtgatcatcaacggcctcgacgtgaatggcggcgaactcaccgtttacgagaaaaacctcacggacggcagcgcacccgactccacggcgttgacccaaaacggcacgtttaccatcaccgcactggacggcgtcaccacgctcaccgtcggcggcattgctgtcgtcaccaacggcgtagccgcaggctttccgcaatcggtcaccacgccgctgggcagtacgctgaccatcaccggtttcaacgccaccaccggtgtcgtcagttacagctacacgctggtcgacaacgaagcgcacccgacggccaacggcgcgaacaatctgccagagcaattcgccgttaccgtggtcgatgacaacggcaccacagccaacgccacgctcgatgtgaacatcgtcgacgacctgccgaaggccaacgatgacagcaacggaacagcgtcagaaagccaactgaccctgaccggcaacgtgctgactaacgatgtgcaaggtgctgaccgcgtaccgaccggaccagtcacggccggcacattcaccggcacttacggcaccctggtgctcaacgccaatggcacctacacctacacgctgaacaccaacgacgccgacttcaaaaacctccacggcggcggcagcggcacggaaaccttcgcctacaccctcaccgactcggacggcgataccagcacggcgaatctggtgctgcagatccacaacaacgacgatccggtgatccttaacggcctcaacgtcaacggtggcgaactcactgtctacgagaaaaacctcagcgacggcaccgctccagacaccccggcgctgacccagagcggcaccttcaccgtcaccgccctcgacggtctgcagaccctgaccgtgggcggcatcaacgtggtcagcggtggcgtggcggcaggcttcccgcaatcggtcgtcacgccgctcggcagcacgttgaccatcaccggttacaaccccgctaccggcgtggtcagttacagctacacgctggtcgacaacgaaacccatccgaacgccaacggcgccaacagcatcaccgagaacttcaacgtcgttgccacggacaccgatggcagcactgccaacggccagatcaacgtcaatatcgtcgatgatctgcccagcgcccaccctgacgcggcgtcggtggcggagggcggcacggtcagcggtaatgtgctgaacaatgacatcggcggcgccgatggcccggccgtgaccggtgcggtagtcggtgtgcgcgccggctccgatacctcgacctcggctatcggcggcctcaacagcaacatcaacggcacctacggctacctgaccctggacgccaacggcaacgccgtctaccacagcaatcccaacgtcgtgaacggcccgggcgcagtggatgtgttcacctacaccgtgcgcgatgccgacggtgatgaaagcactaccaccatcaccatcgatgtcgccaacagcaaactgtgtgcgaccagcgacaccgacgtcaccgtcttcgagaaagcgctggatctgaccaaggacggcgcggatctggcgcccggtacggtcactggcagcgacccgaccagcaccggcgaaactgcgtccggcacgctagtcggctcggtcactggtgcggtcggcgcgatcagctatgcactggtcggcagcgccagcggcaactacgggcagatcgtcctcaaccccaacggcacgtacacctacaccctgacctcgccggcgagcaccacgccgcatgccgacgatggcgccaacagcctgactgaaaccttcacctatcaggccactgattcactgggcaacatcgtcaccagcaccatcgtcgtcaacatcgtcgatgatgtgccgaaagccgtgaacgacagcaacgccaacagcgctgcggaaacgcaattgaccctgactggcaacgtgctgaccaacgacgtgcaaggcgccgatgtggtcgcaaccggaccgaatgccgggccgatcaccgccggcaccttcaccggtacttacggcacgctggtgctcaacgccaacggcacatacacctacacgctgaaccccaacgatgccgacttcaaaaacctgcacggcggcggtaacggcaccgagacgttcacctataccctgaccgacgccgacggcgataccagcaccgccaatctggtgctgaacatccacaacaacgacgatccggtgctgctcaacggcctcgacgtcaatggcggcgaactcaccgtctacgagaaaaacctcggcgacggcaccagccccaataccccggcgctgacccagaacggtactttcatcgttaccgcgctcgatggcctgcaaaccctcaccgttgggggcattgccgtggtcaccaacggcgtggccgcaggtttcccgcaatccgtcgtctcgccgctgggcagcactttcaccgtcactggttacaacccggccaccggcgtggtcagctacagctacaccctggtcgacaacgaaacccacccgaacgccaacggtgccaacagcctcaccgagaacttcaacgtggtggcgacggacaccgatggcagcactgccaacggccagatcaacgtcaatatcatcgacgacctgccgaccgccaaacccgacaccggctcggtggcggagggcggtacggtcaacgtcagcgtgctcggtaatgacatcagtggtgccgatggcgcggccacggtggttggcgtgcgcgccggcagcaacaccggcacttcggccatcggcggcctcaacagcaacatcaatggcaacttcggttacctgaccctcgacgcggcgggcaatgccgtctatcacagcaacccgaactcggtgagcccacccggcgccaccgacaccttcacttacaccatccgcgacagcgacggcgatgaaagcaccacgaccatcaccatcaatgtcgccgacagcaaactgctggcctcggtcgatcaggacgtgacggtctatgaaaaagccctcgacctgagcaaggacggcgcggatctggcccccggtacggtcaccggcagcgacccgagcaacactggcgaaaccgccaccggcacgctggtcggtgcggtcactggcggcagtggcgcgattacctacaccctggtcggcagcgccaccggcagctacgggcagattcagctcaatgccgacggcacctacacttacacgctgacttcggcgccgaaaacctcgccgagcgccaacgacggggccaacaccctcagcgaaagtttcacctacaaagccactgacgctctgggcaacagcaccaccagcaccctcgtggtgaacatcgtcgatgacgtaccaaaagccgtggcctcggatcgctcggtggcggcggtggagatcgattccaacctgctcatcgttctcgacatctccggcagtatggccgatgcctccggcgtgccaggcctgtcgcggttggccctggccaagcaggcgatcagcgccttgctcgacaagtacgacgacctcggtgatgtcaaagtccagctcgtcaccttcagcagcaacgccactgaccgaacctcggtgtgggttgatgtggcgaccgcgaagacgattctcgccggtctgacggcgggtggcggcaccaactacgacgccgccgtggcggtgatgcaaaccgcgttcaacacctcgggcaaactcaccggggcgcagaacgtcggctacttcttctccgacggcaaacccaacgaaggtgacatcaacgctgctgacgaagccgcgctgaaaaacttcctcgatgccaataacatcaagaactacgcgattggcctgggcagcggcgtgagcaatgccaacctcgacccgctggcgtacgacggtatcagccacaccaacaccaacgcggtggtggtcaccgatctcaaccagctcaactcggtgctgtccggcaccgtacagggtgcgccggtcaccggttcgttgctgggcgagggcggcaccttcggcgctgatggtggtttcatcaaatccatcgtgatcgacggcaccacctacacctacgatccgaaagccctcagcggccaaggctcgttgacgccaagcggcggcaccaatcacggtactttcaacaccgccaacaacacgttgagcatcgccaccaataacggcggcacactgctgatcaacctcgacagcggcgactacacctacacctcgcagaaaaccacggcggtgctgatcaccgagaacatcggcttcaccgtcagcgacaacgacggcgacctcgccagctcgacgctgaccgtaaaagtgattcctaatgcgccgccggtggcggtggatgaccacgtcatcaccaacgtgctctcgggcaacatcgtcgtgccgggcgagctgctgctggccaacgacaccgaccccaacggcgataccctcaacgccacaccgaccagtttcaacaccggctggatctcgaaagccgcggacttcaccggcaccggcgcgatcaatttcactggcaccaacgtcaacaccgccgccaaccagaacctggccaacgtgcgcagttcgttcagcgccaacgctgcgaccatgactgccctgcttgtggtcagcggctatctcggcgcagtgaccaacagcaacgccaacgatgaagaccgcatcaccgtcaacctgcgccaaggcgaaaccctcaacctcgatcacaacctggcggccggtcacgtcaccatggagtactcgatcaacggtggcgcctacacaaccctggcggacgggcaaaccctcaccgcgtcggccgatggcgtctatcagatccacatcaccaacatcgccaatcccagcggcggcggtaaccccaacgcagcggaaaactatcagctgaccatgaccctcaactacgccggtgcccacgacatcactccggacttccacggcagctacaccgccaacgacaaccatggcggcagcgacaccgccaacgtcagcatcagctatcaggacggccacaccctcactggcactgcgggggatgacgtgctggtggccggcagcggcgacaacatcatcaacgccggcgacggcaacgatgtgctcagcgcaggctccggcaacaacgagctgcacggcggcgccggtaacgacttgctctacagcggcccgggcaatgacctgctcgacggcggcactggcagcgacaccgccagttatgcccatgccacggccggggtcacggtcaacctcggcctgctcggtgcgcaaaacaccctcggcgccggcaccgacaccctgaccgggatcgagaacctgatcggctcgaacttcaacgacaccctcaccggcgacaacaataacaacgtgatcaacggtggcctcggcaacgacatcctcaacggtggcggtggcgacgacctgctgatcggcggcatgggcaacaacaccatgaccggcggcgcaggggccgataccttccagtggctcaagggcaacagcggccacgacctgatcaccgacttcacccccggcaccgacaagctcgacctgtcgcaactgctgcagggcgaaaacggcaccaccgcgtcgctcgacgactacctgcacttcaccgtctccggcagcggcgcgtcggtgatgaccagcatcgacgtcagcgccatggccggcgccacgccgaaccagaccatcgacctcgccggcgtcaacctcgccagccattacggcgtgaccccgggggcgggcggaatgatcgccagcgggcacgacacggcgacgatcatcagcgggatgctgaatgatcattcgttgaaggtggatacggtttgatcgagggctgaaacgacaaaacccgccgccccggttgatcggggcggcgggttttttttgtgtctgaagatatctattgcctgtgaataagccatcgcgagcaggctcactcccacagtggatttgcgatggtcaccatttttgtgcccgacaaaaatcccctgtaggagtgagcctgctcgcgataaacacctgacagccacccaatccctcacaggttcactcaatccctgtgggagattctatggttgaggggaagccctcaacctcccttcggctggtattcgctttgccccttcagcagcacgaatactactcgcgcaagcttgcgagccaatatcaacagcgcctgtgtcgtactgaacccacggtttctttgctcctcgtagaagcttttccaagccggtgtacggctggccgacatggctgcgttatggagcagtcgccggcgaccgtccttttgtcctgactgcgacacgcgcaaatccatccccaaaaacgcaataaatgcatccgcgtttttgaagtcgccccgctgaaatgttgcgatcaaacgggctccggtcaaaaaaccaataccttcaacgtttgtgcagcgcttcagatctgcgagcagcccagcctcttttaattgatcgttgatcatcttcacgacttgcagcttgaagctgtcgtcgaatgccctgcgttttttggtcatgaataactccccgatagatgtattttccacctatcggggtttccggggaaattagaccactgcatataacgtaattgaaccgtatttcgccgtttcatgcgcctgagaaaaactctgcgaaactgtattgaatacgcttgagtatcctcctgatggcggaacgcagcaccacagttcaccagcgctcaatcgaataggactattgaagcgtttcagatggtctagatctgattgggtgaatggcctgtggcctcgtctattcccaatgttcgttgctaaatctgttggcacatgaaagctagctaccaaatcccatacgttagaaacgacaacttgataagtcacgaatttgcctgcgctatcatgtacatcgataaatgctgacccgtttttgactccagttacttcgccgcgactgtctacagttgcaacatttatgttgcgagaccaatatctatagggaggtgtgccaccggagggtaatctggtggcgaaatttccaggtactgggcttgtgttccaccagtttattttaaaagctgacaggcgaagaggggttgtatctatagccagttccttgactattacattcagcgtccgcgcagccgatacttggccactgccatacagcgcggtggcggtgaagctgtgagcagccacgctcaagcccgtaatgatcagctcccaaaggcctgtcgtcagattaaccgtcgcctcacctttgacggtggcgccatccttgatctggactttctgacctttagccccggctcctgaaagtttgactgtggtgtcgacggtcgtaccgccctgaggaatcgccacccctttggagtccagggcctgagtgatggtcggtgcggtactggcgattaccgtcaatgtccgcgcagccgatacctgtccactgccatacagcgcggtggcggtgaaactatgggcggccacggtcaaaccggtcacagtcagttcccacaaacctgtcgtcagattaaccgtcgcctcacctttgatggtggcgccatccttgatctggactttctgacctttagccccggcccctgaaagttgcaggtcagtagcgcgcaatcggcgctgtcgccgttggggttttttgcttgatcgggtgagtcatcgtgatgctcatgccgctgcaattgagccatgccgcgtgacttgtcccgcgcgataggcaggggattagccaccttcaaaaccatggagtcagcctggcgaatgttcaacgcaatggctggcgtcggtttcaactcgacatcacgcgcgttaaccgcgagcggcttcagcacgcgcgcatgcccgctcagctcggacgccgggttcagctccgccaaccgcgacgccgaagccgtcaaccattcccgcgcccgcggcgacttgatcttcgccaataccttgctgctcaagcgcatctgcacaccgacgccgccacacaccctcatcaacagaaagctgatcagcagttcgacgcgaacttcggcgactacttccgccaggtactgcggtggcaacatcttcagccaactggtaaatgccgccagatgaatgaacagcagcggctcatcactgagcatcagcaaagcgttggcgatggcttcgctggaggcttgcagcagcgccgcaagttcaaccgggctcaggtagcccaggagtttttcgctgttggcctgcaagtcggcgaggagagcgaacagttgcttgatgtcatcccaaaccccgttcaggacattctcgaatccgcgccagtctgcctgctgcaactggccataacggtcaagaaatccggcgctggaaaactccttccactgcggctggaacccagtccactcgtcacgcagccagccttccagatgggcgagcgttgcctcgtaggaggcatacagcgtccgcacatgctcggcgcaaacatcgggaaagaaggtgatgcgataacgctggccccgatcgcagtcggccacttgcagaatgccgctcgaaccgatggtgtagtgcagcggctcgccaaaggtcaggacgccgtcgatttctgccagcaccggttcgagtgttaccggggtatcgccgatcggcacgaaccgagccgcgtcgaacatgtgcaccagcgtcaacggcccgctggccggacacatcgccaccgatgaactgatcggttgacgagacttgatcggtgcgctgaggcgtacgtcgttgccgacggtgaacacttgttcggcatccagcgccgtcccggtccagaactgctcggcccaggcctcgtagtcgttgaggcacaggcgaaactccctgatcaggctttcaaaatccggatgccggggattgagcgctgcaactaccagcaggccgatgctgttgttcagggccagtaaccgatcggtctcaagcattcgcagtctctcgcgcacgtcaaaaaaggtgcggggactttgctggggatgaaaaaggaaagaagtcgggtaagtaggtgatgcctgtaggatgtttcgctaaatgcttgcgagtagttcatcggttcaacggagattgcccgttgcccaatgtccttcgcgctcgttatgctgctgaaccctttaatcagatccgagcagcgacctgcttcaggcgcctgggatgtcttttttaacggatccgatgatgaatgcaccgctgaaggcgttcggcccgatcaaggccgtgattttcgatatggacggtttgctgctggacaccgagggcatttacaccgaggtcacctcgctgattgcccagcgttacgggcgcaccttcgactggagcgtcaagcagaacatcatcggtcgcggtgccaacgatctggcgaactacgtggtgcaggcgctggatctgccgatcaccgccgaagaatttctggtgatccgcgagccattgatgcgtgagcgttttcccactgcgcaagcgatgccgggtgccgaggaactgatccgtcacctcaaggcgcacaacattcccatcgcggtgggcaccagttcgtcgcgccagtcgtttggccagaaaaccacgctgcaccgcgactggtttgcgttgtttgattacatcgttacggcggacgacccggaagtcggcgcagctaaacctgctccggacattttcctcactgctgcccggcgtctgggcgttgcacctgaagattgtctggtgttcgaggattcgccatttggcgtgaccgccgcgaaagccgccgggatgactgccatcgccatccctgatgcggccatggccgatgaaaaatacgcacacgctgacgggatacttcgtacgctgaaagccttcacaccgagtgcctgcggcttgccggcgctggaatgggcgtaggcatctgacacagaaaaacgccgcccctctgtaaaaagaggggcggcgtttttcgttcaggcgattcggaaacaatcaggcgccgaaaccaccgtcgatggtcaggctggcaccggtgatgtaaccggcttccgggcccgccagataagcgacgaagctggcgatttcctcggctttaccgtagcgaccgacggccatcagcgggatcaggctttcggcgaagtcgccctgcgccgggttcatgtcggtgtcgaccgggccaggttgcacgttgttgacggtgatgccacgagggccaagatcgcgggccaggcctttggtcaaaccgaccagcgccgatttactcatcgcatacacaccgccgccggcgaagggcatgcggtcggcgttggtgctgccgatgttgatgatgcgtgcgccttcgcccatgtgtttggcggcttcctgcgaggcgatgaatacgctgcgaatgttgatcgccacagtctggtcgaagtcttcgagtttgaagtcttccagtggtgcgacggccagtacgccagcgttgttaaccagaatatcgactcggccaaaggcttcgacggtggcgttgacggcgtggcgaatggcggcggcatcggcgctgtcggctttgatcgccagagctttgccaccgttggcggtgatgctgttttgcaactcttcagctttcgcgacggagctgacgtaagtgaaggctactgcagcgccttcagcggcgagacgtttgacgatggcagcgccgataccacgggaaccgccttgaatcagagcgactttaccgctgaggtgttgagtggtcatgttcgatctccagagtgttcaaggcgggagtgccttggtattggtggcgagtatcggcttggtatcgacaactgtgtagaccatgattgctatagtctgtgtaaaccagaagtttatagtggcgatcatggaaaccttcagcagcatcgaatgcttcgtgcgcagtgccgaggtcggcagctttgccgaagccgcgcggcgcttgagtctgaccccggcggcagtcggcaagagtgtggccaagcttgaagtgcggcttggcgtacggctgttccagcgtagtacacgcagcctgacgctgaccgaggccggacaacttttcctcaatcaggtcagtggcagcctgaccactattcaaaatgccgtggccaatctgtccagtgtcgaagggcttccggcgggaacgctgaaggtgagcatgggcgcagcgttcggctgtctgcacatcgtgccgatgctcggagagtttttgcggcgatatccggcgatcaacccggactggcatttcgataatcgccaggtcgatctgatcgggcagggcttcgacgcggccatcggcggcggcttcgagctgccgcaaggcgtgattgcgcgcaagttgacaccggcgcatcggatattggtcgcgtccgctgagtatttgcagaccaattccgtgatcgccgagccggacgacctcagccatcacgacggcattctgatccgctcaccgcaaaccgggcgtgtgcgttcctggcagttgaccgggcgcaatccgcagaattgtcggccgttgacgctcaaggcgcgaatgaccatgagtgattccgaggccgcttgcaggacggcggcgcaaggcttggggattgcgctggtgagcatgccgtttgcggtggggtatctggagtcagggaggctgcagcgggtgttgccggactggtttgtcgatgatggcaatatttcgatttactacgccgagcataagttgttgccgggcaagacgcgggcgtttgtggattttgtgattgagcagtttgcggagcgggggttggcgcggcggttcagtgcgatttgagcaaggcatcagaccgaggtgtggccatcgcgagcaggctcactcctacattggaatgcgtccgcctgtaggagtgagcctgctcgcgatgaacgataacgcggtctagcgggcaaaccgccgcggccagccaatgatgttcttcggtcgcggcgtcgcatacgttcgcaccttcgacgtcgacaagcgcaagcgcaccagcgattccgcaatcgtcaccgctgccgtcacgccgtccaccaccggcacgccggtacgtcgacgaatctgttcatccagcccggccatgccgccgcaacccaggcaaatcacctcggctttatcctgtgtcaccgccagttcggcctgttgcacgatggcttccagcgcacgctgcggttcgtgttccagctccagaacagccaaaccactggcacgcactgaagcgcagcgatcccacagaccggacaatttcaaccgatcctcaatcagcggcacggtgcgatccagcgtggtcaccaccgaatacgcgtggccgagaaacatcgccgtactcgccgccgcatcagtgatatccaccacaggaacgttgagtaattcctgcaaaccttcacggccatgttcgccataaccggcctgaatcaccgcatcgaacggctgatcgtaggccatcacccgatccatcaccgcgatggccgccaggtagctttcgaaattgccttcaatcgagtcggcgccaaagaacggcgtcaaaccgacgatttcagtacccggtgaagcgatagcctgcgccgagcgggcgatggcatcggtgatggattcggtggtgttgacgttgaccacgagaatacgcatggggaaatccttatagcgggcagttctgcgacccgaagtccgggccgcgagggagttaatggcagacgttgtcgaccgcaatggattcgccactgacgtcggcgtagtgcggctggcgtttggcgatgatcaggtaaagcattccggcaatccccgcaccgatcagccaggagaacggcgagacgttgtggaaaccgggaaccagcgcgaggacgatggcgatcagcgccgcaggaataaacgccgccaccgcacggaaattgatcccgcggctgtagtaataagcgccgttgggatcttcgctgtagagctgcgggacgttgatccggcctttgcggatcagccaatagtcgaccatgattacgccgtacagcgggccgagcagggcgccgaggccggacaggaagtacacgatcaccaatgggctgttgtagagattccacggcagaatcaacacggcgatggtggcgctgatcagcccggcgcggcggaaggtcaggtattttggcgccaggttgctgaggacgaaggccggagcgacgaagttggccatgatgttcaccgccactgtgacgatcagaaacgccaggcaaccgagcaccaggaagaacgtgttggggatcgaggcgatgatctcggtcgggctttcaatgatccggccattgatctgaaattgcgcgccacagagcaggacagtaatcgcggcgaacaccagaatattcaccggcaaaccccagaagtttcctaccttgatggtcttgcggcatggcgaagagcgggcgaagtcgcagaaattgaggatcaacgtgccgtagatcgccagccacaacgcgccgccggcaaagatgttgcgccacatctcgccaccggtcagtggctcgcgagtcgaccaagcgatggtcgcgttggcctggaagtacatccacgcggcaagcgcagcgacggtcagcagaatcaccggcccggcaaaggcttcgtaacggcgcaccatttccatgccgtaggcaaggatcgccagttgcacgaaccagatcgccacgaaacacacccagcccaaagtcgacaggccaagaatcgagttgtggtcgtattcggcgaaaccggggtgtaccgctgtgagcaatacgcgaaagaccaccgaggccaggtacgtctgaataccgaaccaggcaatggcgataaccgcccggatcaacgcaggaatctgcgccccgtgaatgccgaaactgatccggctgatgaccggaaacggcacgccggttttctgtcccatgtagccggacaggttcatgaagaaatacaccagcgccgcgccgatccccagcgacaacagaatctgccagccacccaggcccaacgcgtacaagccgatggcgaaggagtagttggcgatgttgtgcacgtcgttcgtccacagggcgaaaatgctgtatttgccccagcgtcgaccttcggccttggtcggtgccaggtcgctattgtgcaggcgcggactgagttttagcggctcggtgagtccgtcatggggtaacggttgggtaacgggagaggcgggcagattcagcgcgatgttattggagagacttgtacgcattccggcaggctcctgatgttcagggccgcgatgactgtacataagccgtcaggctcgacaaatcttcgtcgcggcagtgaaaaacatcactggttacggggcatctgcagcctgtacgggatagggcgcttcaggcttgcggatcgaaagtgtgggtatgttctgcagttttgtatacaaaacatgtatgcactaaagccagatttgtgccagttagcggtctatgcgcagctgtgctcatttcgaaaagttatcgatgcacgctaagtctttgaaaataagtggttaaaaattgaccgtttgaacaggtatttatttttgatgagggattttcaggaaaggcgagagcgaggggttttcaggcgggatgtaacttttcagggcgcggaaacaaaaaagtgcacacataaatggcaccgatggtgacattcgtgtgtacacatttattgagtcgctagtgacctttgtaggagtgagcctgctcgcgatagcggtgtatcagccaaaaaaatcatcggctgataaaccgctatcgcgagcaggctcactcctacagggggaaatcagcgcggcagggagttacgccttgctgatgatattccccgcatgcagcccgcattctttctgcgtcgcttcttcccaccaccagcgaccttcacgctcatgctggttcggcagaacagggcgggtgcacggttcgcagccaatgctgatgaagccgcgctcatgcaggctgttgtacggcaactcgagcatgcggatgtagccccagatctcttcgctggtcatctgcgccagcgggttgaacttgtacagggtgcgctccggcgtggagaacgcgccgtcgatttccatcaccgccacggcgctgcgggtgccggggctctggtcgcggcgctggccggtagcccaggctttgacgccggacagtttgcgccgcagcggttcgatcttgcggatgccacagcattcgccgtggccgtccttgtagaaactgaacaggcctttttccttcacgaacggttccagtttcgtgtagtccggcgagacgatttcgatatcgatcttgtagtgctcgcgcacctgctcgatgaagcggtaggtctccgggtgcaagcggccggtgtcgaggctgaacaccttgacgtttttgttgagcttccaggccatgtccaccagcaccacatcctcggcgccgctgaaagatatccacaagtcatcgccgaactcggcaaacgcgagtttgaggatgtcttgcgcggatttgttggcataggtcgtggcgagttccacgacgtcgaacgttgcactcatcagggcggcttcctacaggtcagtggcgctgggcgctctatatggggccgatggtaacaaaaagctgcgtggctcggggtgcgctgtgcgttgcgcgagtggatttgagccgctagagttcggcctcgctcgactcaaataatcaatacaaacgggagtgtcttgtggaaattgcttgcctggatcttgaaggggtgttggtgccggaaatctggatcgccttcgccgaaaaaaccggaatcgactccctcaaggccaccacccgggacattcccgattacgacgtgctgatgaagcagcgtctgcgcatcctcgacgagcacggcttgaagctgtccgatattcaggaagtgatcgccacgttgaagccgctggacggcgcggtggagttcgtcaactggctgcgtgagcgctttcaagtggtgattctgtcggatacgttttatgagttttcccagccgctgatgcgtcagttgggcttcccgaccttgctttgccatcgtctgatcactgacgaaaccgggcgggtgaccagctaccagttgcggcagaaagatccgaagcgccagtcggtgctggcgttcaagagcctgtattaccgggtgattgcggcgggggattcgtataacgatacgacgatgctgggcgaggcggatgcggggattctgttccatgcgccggagaatgtgattcgcgagtttccgcagtttccggcggtgcacagctttgccgagttgaagcaggaattcttaaaggcctccaaccgcgacctcagcctgtaagcctggctacctgatgatcgttcccacgcggagcgtgggaacgatcattgctcagagggtttgcagggtttcgaggaggattctgactttagtaatcgactcctgatactccgcctgccagtccgaatcagcaacaatcccgccaccgccccagcaacacacctgcccatccttgaccaacagactgcgaatggcgatggagctgtccatctcgccgcgcacatcgaggtacagcaacgagccgcaatacaaaccgcgccgggtcggttccagttcatcaatgatttgcatcgcacgaatcttcggcgcgccggtgatcgagccgccggggaagctgccggcaatcagatccagtgcatcgcggtcgtccgccagatcaccggtgacgctgctgaccaagtgatgcacgttcggatagctttccagactgaacagctccggcacgcgcaccgagccgatgcggcaggtgcgcccgaggtcgttgcgcagcaggtcgacgatcatcaggttttctgcgcgatccttggggctggccagcagttcggcggcgttggcggcatcttctgctggagtcaggccacgggggcgagtgcctttgatggggcgggtttcgacctgacgctggctgactttgacaaagcgctcgggcgacaggctcaacaccgcgccgccgtcgggcaagctctggaagccggagaacggcgtggggcaggcttcgcgcaatttgcagtaagccagccacggatcgccctgacacgccgcgcgaaagcgctgggcgaagttgacctgatagcagtcgccggcctggatgtaatgctgaatgcgttcgaaggcctgacggtaatcgtcgggcgagaggtcggcggtcatcggattgttcagtttgaacggtaccaatgtgtctgtgtgtggctgagtgagcagcgctatcagccgttgcttctcgctatcgatcaccgacgggtggaagaccaattggctggtggccgactggtgatcgctgatcagtgcccagttgtacaggccaaaacgtgcatccggtaattgcagatcatcgcgagcctggctcggcaggttttccagatgccggccgaagtcatagctcagatagccgatcaagccgccagcgaatggcagttcgaaacccgctggtaaatcagcctcaccgaggcgattcagattgtcacgcagacgttgcaggaaatggctgccgctctcgtccggcaataccgccagttgttccagcggccaagcgctgagcaggtcataacggccacggtcagcgctcgggcggccactgtcgagcagcacggcgccgggggcgttgcgaatggccgcgaagtagtcggcgggattggcgcggtagggcagcgggtgtacggaacaggtcagcatgggcggggcagatcggccgtggaggcggggtggggattgtagtcctctctcggctgtcagatcaaaatcaaaagcctaccccctcaccccagccctctcccccaagggggcgagggggaaagggagccgatcttcatgcttttcaagatccaggttcggctcgatatctcaagctggcggggggaagggggcagatcgggggcttttcaaaacttgagttcgactcaagactttcaggtcggcgtacctcgaacatccacctcggtcagtcccctctcccactgggagagggttagggtgaggggcttttcagcttttagccttccacagcaggaatatgcccaaacatttcctgggtaaacgccacgcgctcttcaaccgattccgtcaccccacgcgccttcagctcttccagccgcgcttccaccgcatgcgtacgcaacgtcagcccacagtcgttagcgatctggatattcagccccggccgcgcattcaactccagaatcagcggacccttctcctgatccagcaccatgtccacgccgatataacccaacccgcacagctcatagcagccagcggcgagtttcatgaaaccgtcccagtagggcagttgcacgccgtccaccgcgttggtggtgtcggggtgtttggtgatgatgttgttcagccaagtgccgcgcagggtcagaccggtcgccagatcgacaccgacaccgatggcgccctggtgcaggttggccttgccgccggactgccgggtcggcaggcgcaacatcgccatcaccggataacccatcagcacgatgatgcgaatgtccggcacgccttcgtagctgatgcttttgaaaatctgatccggcgttacccggtattcgatcagcgcccgatcacgatggccgcccagcgagtacaaaccggtaagaatgcttgagatgtgatgctcaagctcttcgtgggcaatgatcttgcccgataccgtgcggtagcggccttcgaaacggtcggcgacaacgatgatgccgtcaccgccggcgccctgggccggtttgatcacgaagtcgctgcgcccgccgatgatctcgccgagcttgtcgatttccttctcggtggagatcacgccatacagttccggcacgtgaatgccggccgcgatggcgcgctccttggtgatgatcttgtcatcgacgatcgggtacagactgcgcttgttgtacttgagcacgtagtcggcgttacgccgattgatgcccatgatgccccgcgcctccagggccttccaggtcttccagaaaccgaacatcaggcgtcagccttcttcaggaaagccttgaagcgcaccagttccgtcaggcggtagccgcgataacgccccatcgccagcatgaagcccactaggatcaacaggatcgccgggaaggtgaacacgaagtagaccagttcaggcacggtcatgatcaggtgcgccagggacgcggcgaacagcgtgccaatcgcgactttcatcgcatggctggcgccgcgctcttcccaggtgatcgacaggcgttcgatggtcatggtcagaatcaccatcgggaacagtgccacggacaagccgcgctccagaccgagtttatggctgaacagactgatagccgcgatcagtaccacgacaaaggtcaacaccaccgacagtcgcggcagcatttgcaacttcaggtgttccagataagaacgtaatgacaggcccagcgccgtaatcacggtaaacagcagaatgccgaagcccagttgcgtttcacggaaggcgagggcgatcagtaccggggtaaacgtgccgagggtctgcaggccaatcaggttgcgcaggatcaggatcaccagcacgccgatcgggatcatcaccatgatcatgaaggtctgctgggtctgcagcggcaagccgtacagcgagtattcgaggaagttggcgtcggtgttttcgtcggtcagcttggccagacgaatcgcgttcatctcgctgttgttcaggctgaaggtcacgttggctttcttgccgccgtcgacggtgatcaggttttcatcgccggtccaccacagcaggcggtcggtcggcaggccttgctcgccggtttccggattgaagtacagccagtcgttgccgttgaagctgcgcagccacagttcgggcatttgcggctgatcggcgacgaggcggatggtgtggactttttccaccggcacgtgggcgatggacagcagcagttcgacgatcttggctttgtgcgcggtcgacggatcgccggccagcagcagtttcacattgtcatcgttgaggttgttgacgcgtttgatcgcctcgccgatgaaggtttcgacgtcagccgagtgctggcggatcggcgcgagcagggcttcggcggcgattttttccgggccttcgatggcgatgctgtcgcggaaggtcgggcctttgatcttggttttttccgcggtgtaacgcttggtcagcaccagacggtaataaagcgtctggttgcccttggcgcgacgggccgaccaggtcaccttgcggttaccgtcgacgcggttgacggcgacgccgtagttattggagataaagctttcgttgaggctgacgtaatcgcggctcaatggcggcacgaacatctggatcttcaccggatccttggtgctggcgacgaactcgaccttggcgtcgatgttccacaagtcgtcggtcgcatcttcggtcaccgggatgccgagtacgaaaatctgataggccgtaaccgaaacgcccagcagcaccagaatggtgatcaggattttcaggtggaaggttagagaacgcatggaaattactcggcggtatgagcggcgatggtgcaggcgggtttgccggcagcgtatttaagactggggtcgaccagcgcatcgaagcgtttcagcgcctcggagccaatcaaaagcggatattggaacgcacttcggtcggtcaggttcacttcgatgctgcgcattgccgtgcccatgcagatatccagctcgatcaccggacgggcggtgtacttcttgccttcttccgggtcgtagtcgccggcacggcgcttgatcttgctgacccgggccagtggccgttcgatcgggtgcgaatgcgcggcgtcgatggccaggtagaaacgtacccaggactcgccgttgcgtttgaagcgtttaatgtcgcgggcactcagcgaggcggttttcgcgccggtgtcgagtttggccgcgacttccagattgatgccgtcaagcgaagcgtattcgttgaggccgtacacggttttttcccccgcggcggcaaggccgggcaggcaaaacagggcaaagaatgtggggaagggcttgagtctcataaatcctggtgcgcagcgttccgttttcggttcaggtccttggcaaaacttgcgcaaggcccttcgtgtgcctatcagctttttatgacaagccgtacaaatggccagcaaatgcgggcggcattctagcacggtgggtttatggcgccagcgcttgggccggtctataaaagatcaaaagatcgcagccttcggcagctcctacattggatttgcgtgcgccctgtaggagctgccgaaggctgcgatcttttaaggttattagacgattgtcgacaatacccatttatcctttgactgacgcgggcgaattggctagtttttgccgcattggatttaaaggtgtcgacaatcatgctggatcaactcgatcccccggtcattagcggcgacgattccgagacgctttcggaaaacgtcttccggcgcattcaagcggccatcgtcaaaggcgagatcgcgccaggcagcaagatctccgagccggagctggcgcgcacctacggcatcagccgcgggccgttacgtgaggcgatccatcgtctcgaaggccagcgcctgctggtgcgcgtaccgcacgtcggcgcacgcgtggtatcgctcagccatgccgaattgctcgaactctacgaaatccgcgaatccctcgaaggcatggcctgccgtctggcggccgagcgcatgagcgtcgaagaaatcgacgaactgcgccgcgtgctggagacccatgagcgcgacgcggcgtttcaggctggcgtcggttactaccagcaggaaggcgatttcgatttccactaccggatcatccagggcagcggcaaccgtacgttgacgcagatgctctgcggcgagctgtatcaactggtgcgcatgtaccgcatccagttttccaccacaccgaaccgcccgcgccaggcgtttgccgaacaccaccggattctcgatgccatcgccgaccgtgacggcgaactcgcggaattgttgatgcgccgtcacatcggcgcctcgaaacgcaacattgcccgtcattaccaggacggcgcccacaataagacagccactgaacgaggtgagtcatgagttccaagcacagcactccaggccagcgtttccgcgatgcggtcgccagcgagcatccattgcaggtggtcggcgcgatcaacgccaaccacgcgctgctggccaagcgcgccggtttcaaggcgatctacctgtccggtggcggggttgccgcaggctcgctcggcgtgccggatctgggcatcaccggcctggatgacgtgctgaccgacgtgcgccgtatcaccgacgtttgcgatctgccgctgctggtcgatgtggacaccggtttcggctcgtcggcattcaacgtggtgcgcaccgtcaaatcgatgatcaagtttggcgcggcggcgattcacattgaggatcaggttggcgccaagcgttgtggccaccgtccgaacaaagagatcgtcagccagcaggaaatggtcgaccgcatcaaggctgcggtagatgcgcgtaccgatgacagcttcgtgatcatggcgcgcaccgatgcgctggcggtggaaggtctggaatcggcactcgatcgcgctgccgcgtgcatcgaggccggcgccgacatgatcttcccggaagccatcaccgaactggagatgtacaagctgttcgccaaccgcgtgaaagcgccgatcctggccaacatcaccgagttcggcgcgacgccgctgtacaccaccgagcaactggccggcgccgacgtgtcgctggtgctctatccactgtcggcgttccgtgcgatgaacaaggcggcggaaaacgtctacaccgccatccgccgcgatggcacgcagcagaatgtcatcgacaccatgcagactcgcatggagctttacgatcgcatcgattaccacaccttcgagcagaagctcgatgcgttgtttgccgcgaagaaataaagatcaaaagatcgcagcctgcggcagctcctacacagatccctgtaggagctgtcgagtgcaacgaggctgcgatcttttcgccacactccctaacaaattcaagattggagaacacaatggccgaagcaaaagtactcagtggcgccgggctccgtggccaggttgccgggcaaaccgcactgtccaccgtgggccaggccggtgccgggctgacctatcgcggctacgacgtgcgcgaactggcagccgatgcgcaatttgaagaagtcgcctacctgctgctctacggcgaactgccgacccaggcacaactcgacgaataccagggcaagctgagcaagctgcgcgacctgccgcaggcgctgaaagaggtgctcgaacgcatccccgccgacgcccacccgatggacgtgatgcgcaccggttgctcgttccttggcaatatcgaaccggagaaagacttctccgaacagcgcgacaagaccgaccgattgctcgccgcattcccggcgatcatgtgctactggtatcgcttcagccatgacggtaaacgcatcaattgcgtcagcgacgaaccaaccatcggcggccatttcctgcacctgctgcacgacaagaagccaagcgaactgcacgtcaaggtgatgaacgtctcgctgatcctttacgccgagcacgaattcaacgcctcgactttcactgcgcgagtttgcgcctcgaccctgtccgacctgtattcctgcgtcaccgccgccattggttcgctgcgcggcccgttgcatggcggcgccaacgaagcggcgatggaaatgatcgaacgcttctcttcgccggaagaggcgatcaaaggcaccctcggcatgcttgagcgcaaggataagatcatgggcttcggccacgcgatctataaggacagcgacccgcgcaacgaagtgatcaagggctgggcgaaacagctggctgacgaagtcggcgacaaggtgctgttcccggtttccgaagccatcgacaagaccatgtgggaacagaaaaaactcttcccgaacgccgatttctaccatgcctcggcgtaccacttcatgggcatcccgaccaagctgttcacgccgatcttcgtttgctcgcgcctgaccggctgggctgcgcatgtgttcgaacagcgcgccaacaaccgcatcatccgtccaagcgccgagtacgtcggcgttgaacagcgcaagttcgtgccaatcgaacgtcgctgaaatggtgagctgacccggaaccagagagcaccgctagaccctgtgggagcgagcctgctcgcgaagacggactgacattcaccatcgatgtcgactgatctaccgctatcgcgagcaggctcactcctacaagggaaggtgtgaattttgagtctggcgtctgcccaccctttgcaaccaccgtgccccgagtcctgacccgatgaacacagaattgcgcaaaaccctgcccggcagtcctctggattatttcgacgctcgcgcggctgtcgaagcgatccagcccggcagttacgacaccctgccgtactcctcccgcgtgctggcggaaaacctcgtgcgtcgctgcgacccggccacgctcaccgactctctcaagcaactgatcgaacgcaaacgcgacctcgacttcccgtggttcccggcgcgtgtggtctgccacgatattctcggccagaccgcgctggtcgacctcgctggcctgcgcgacgcgatcgccttgcagggcggtgacccggcgcaagtcaacccggtagtgccgactcaattgatcgttgaccattcgctggcggtggaagcgggcggtttcgacaagcaggcgttcgagaaaaaccgcgccatcgaagaccgtcgcaacgaagaccgtttccacttcatcaactggaccaaaaaggctttcaagaacgttgatgtgatcccgccgggcaacggcatcatgcaccagatcaacctggagaaaatgtcgccggtgatccaggtgcgtgaaggcgtcgcgttccccgacacctgcgtcggcaccgacagccacaccccgcacgtcgatgcgttgggcgtgatcgccatcggcgttggcggcctcgaagccgagagcgtgatgctcggtcgcgcgtcgtggatgcgtctgccggaaagcgtcggcgtcgaactgaccggcaagctgcaaccgggcatcactgccaccgacatggtgctggcgctgaccgaatacctgcgcaaacagaaagtcgtcggcgcatggctggagttcttcggcgaaggcgccgctgcgctgaccctcggcgaccgcgcgaccatctccaacatggccccggaatacggcgccaccgcagcgatgttctacatcgatcagcagactatcgactacctgaaactcaccggtcgtgaagatcagcaagtgcagctcgtcgagcagtacgccaagctcaccggcctctgggccgacagcctgaaaggcgcgcaatacgagcgtggcctgactttcgatttgtcctcggtggtgcgtaacatggccggcccgagcaacccgcacgctcgcgttgcagtgtcggatctggcggccaaaggcatctccgggcagtgggatgacgtgccggggcaaatgcctgacggcgcggtgatcatcgccgccatcaccagttgcaccaacaccagcaacccgcgcaacgtcatcgctgccggcctgctcgcgcgcaacgccaacaagcttggcctgacgcgcaagccgtgggtgaaatcctcgctggcaccgggttcgaaaaccgtcgcgctgtacctcgacgaagcggggctgaccactgaactggagcagctcggtttcggcgttgtcgccttcgcttgcaccacctgcaacggcatgtccggcgcactcgatccgctgatccagcaagagatcatcgaccgcgatctgtatgccaccgccgtgctctcgggcaaccgcaacttcgacggccgcatccacccgtacgccaagcaggcgttcctcgcttcgccgccgctggtggtggcgtacgccatcgccgggaccatccgtttcgacatcgagaaggatgtgttgggcgtggtcgacggcaaggaaatccgcctgaaagatatctggccgagcgatgaagaaatcgacgccgtggtgaagtcttcggtcaagcctgagcagttccgtcaggtctacattccgatgttcgccgtccacgaagacaccggcccgaaagtcacgccgctgtacgactggcgcgagatgagcacctacatccgccgtccgccgtactgggaaggcgcactggccggcgcgcgtccgctgaagggcatgcgcccgctcgcggtgctgccggacaacatcaccaccgatcacctgtcgccgtccaacgcgatcatgctcgacagcgccgctggcgaatacctggcgaaaatgggcctgccggaagaggacttcaactcgtacgccacccaccgtggcgaccacttgaccgcacagcgcgcaaccttcgccaacccgaaactgttcaacgaaatggtcgtggaaaacggcaaggtcaaacagggttcgctggcgcgggtcgagccggaaggcaaggtcatgcgcatgtgggaagccatcgaaacctacatggaacgcaagcagccgctgatcatcatcgccggcgccgattacggtcagggatcgtcccgcgactgggcggcgaaaggcgtgcgtctggccggtgtcgaggcgattgccgctgaaggtttcgagcgcattcaccgcaccaacctggtgggcatgggcgtgttgccgctggagttcaaagcgggcaccgaccgtcacaccctggccatcgacggcagcgaaacctacgacgtgatcggtgagcgcaaaccgcgcgcggatctaaccttggtgatccatcgcaagaatggcgagcgcgttgaggtgccggtgacttgccgtctggataccgctgaagaagtgtcgatctacgaggccggcggcgtgttgcaacgcttcgctcaggacttccttgaagagtcggcggttgccgtttaaatcaactgatgtgggcgtggggtttcaggccccatgccctcgttaaggagcatcatggctcacgcaccacaaataaagattcccgccacctacatgcgcggcggcaccagcaaaggcgtattcttcagcctcaaggatctgcccgaagcggcgcaggttcccggtctggttcgcgacgctttattgctgcgcgtcatcggcagccccgacccctacgacaagcagatcgacggcatgggcggtgcgacttcgagcaccagcaaaaccgtgatcctgtcgaaaagcaccaaggctgatcacgacgtcgattacctgtttggtcaggtctccatcgacaagccgttcgtggactggagcggcaactgcggcaacctctcggcagcggtcggttcgttcgccatcagcaacggtctggtcgaggccagccgcattccgcacaacggtgttgcggtggtgcgcgtgtggcaggccaacatcggcaaaaccattattgcccacgtgccgatcaccaacggcgaagtgcaggaaaccggtgatttcgaactcgacggcgtgacttttccggccgctgaagtgcaagtcgaattcatggacccggcggcggaagaagagggcggcggtggctcgatgtttcctaccggcaacttgatcgatgagctggaagtgccgggcgtcggcacgttcaaggcgaccatgatcaacgccggcatcccgacgattttcgtcaacgccgaagacattggttacaccgggaccgagttgcaaagcgcgatcaacagcgatccgcaagcgctgcagatgtttgagaagattcgggcttatggcgcgctgcgcatgggcctgatctccaatctggacgaagcggccaagcggcagcacacgccgaaagtcgcgtttgtcgccaagcctgcagattacgtggcgtccagtggcaaggcgattggtgccggtgatgtggatttgctggtgcgtgcgttgtcgatgggcaagttgcaccacgcgatgatgggcacggcggcggtggcgatcggtacggcggcggccatttccggcacgctggtgaaccttgctgcaggtggcgttgaacgcaatgctgtgcgcttcggacatccgtccggaacgttgcgcgttggcgctgaagccagtctggaaaacggcgagtgggtggtgaagaaagccatcatgagccgcagtgcgcgcgtgctgatggaaggttacgtgcgcattcccggagattcgttctgatccaagagctttaccctcaccccagccctctcccggagggagagggagccgaccgaggtgtcttgggttgtacatcaacctgaaagatcgagtcgattatggattttaagggccgaccgaggtttctgggttgtacatcgacctgaaagatcgagtcgattatggattttaagggccgaccgaggtttctgggtcgtacatcgacctgaaagatcgagtcgattatggattttaagggccgaccgaggtttctggggttgtacatcgacctgaaagatggaggcgattatggattttgagcgccgaccgaggtgtatgggatgttcatcgatctaatcgattatggattcaatgtagatcgctcacgtcggcggacctctacagcatcccccaatcggttccctctccctcgggagagggctagggtgaggggctctcccactgaaaaaacacaaaaagagcaggcaccccagacctgcaatcaagcaaaccagccaagccctgaggaagaccgcaccactcatcattcccgcacaggagaaccgcaatgagcgccaacgtcgacctgaacaaccgccccgactacgaccgtgtcctgcaggacatcgccgattacgtcctcaccttcaaagtaacctctgccgaagccctcgacacctcccgcaactgcctgatggacacgctgggctgcggcctgctggcattgcgtttccctgaatgcaccaagcaccttggcccgatggtcgaaggcaccgtcgtgccgtttggcgcacgagtccccggcacgtcttttcgcctcgacccggtcaaagccgcgtgggacatcggctgcatcgtccgctggctcgactacaacgacacctggctcgccgccgagtgggggcatccctcagacaacctcggcggcattctcgcggttgcggatcacttgtcgcagaagcgcgtggccaacgctgaagcaccgctgaccattcgcgatgtgctggaagcaatgatcatggcccacgagattcaaggcgtgattgccttggaaaactccttcaatcgtgtaggactcgatcacgtcattctggtgaaagtcgcctcaaccgccgtcaccgccaaactgatgggcgccaatcgcgagcaactgttgtcagccttgtcccatgcattcgccgatggtcaggcgctgcgcacttaccgtcatgcccccaacgccggttcgcgaaaatcctgggcggcgggagatgcgtcgagtcgcggtgtacgtctggctgacattgccatgcgcggcgaaatgggcattcccggggtgctgactgcgaaacagtggggtttttatgacgtgttgttcagccataccaacagcgatctggcgttgaaaccggaagataaacgcgccttcagtttctcgcgcgcgttcggcagttacgtgatggaaaacgtcctgttcaagatcagcttccccgccgaattccacgcgcaaacggcttgcgaagcggcggtgaccctgtatccgcaagtgcgcaaccgtctgcatgaaatcgaccgcatcgttatcaccactcatgaatcggcgattcgcatcatttccaaggtcgggccgctggccaatgccgccgaccgcgaccactgcatccagtacatgaccgccgtgccactggccttcggcaatctggtcgccgagcaatacgaagacgatttccaccgggcgcatccgatcatcgatgtgttgcgcgagaaaatggtcatcgttgaagaaccgcgtttcacccgcgaatacctcgaagccgacaaacgctcgattgccaacgccgtacaggtgtttttcaaggatggcagcagcacagacaacgtcgtggtggaatacccgatcggtcatcgccggcgccgtgtcgagggcattcctttgctggaggacaagttcaaggccaatctggccacacggttcaccggccagcgtagcggcgaaatcttttcgttgtgcaaggatcaggcgcttctggagtccaccccggtaaaccgtttcgtcgacctacttgtgatctgacgaaaaacctgtaggagctgccgcaggctgcgatcttttgactttgattgtaaaaaacaagatcaaaagatcgcagcctgcggcagctcctacatggaaggtttgcgccatttttcgatgggtaatttggtgatggcaaaaccgctcaacaaaatcgccgaatagatcatcagctcccgggacagggtttgcccctcgtaccaggcgccgatgatcacggcgaacaccggaaaaatgatgaacacgaacgacagaatgatcgggctcaggcgtttgagcagcaaaaagtagacgatgaatccaccgaccgacgccaccagcccgagatagagcagggcaccccatgagcgcgtcgtgatgtcctgaaaaaccggcgcctcaacgctcaacccgacaataaataacattgccccggcgatgccgatgggcagcgtgttgtaggtgatcacgctgatcgcactgccgtgttttttcgtcaccacgtagcacagcgcatgcatcacggcggcacagagaatcgccagcactcccagccattcggcctgatccagatgcaaaccctggctgcgaataatcatgaacaggctgccgaaaccaatcgcgatgccgagcatttgcgacgggtagattttctcgcgcagaaacagcgcggaaaacaacaggataaacaccggcatgcaactgaacagcagcgctgtcaggccggacgagacgtgcatttcgccgtagttgagcaggtagtaaggcaggctgaaatacgacagcgtgacgaacacgcaaaaccagcggctttgccgggggaacaacagcggttccttgcgcaacaacgcgaaactcagaaacagcggaaacgcgatcagaaagcgcagtcccgcggcggtcagcggcggcacgctttccacggcaatcttgatccccaaccatgtggtgccccaactcaggcagacaatcagaaacaaggtgctggtgagcagtccggcgagccagggtttgctgatgttcatcggtgtgctgacggcagtcgacatgtgggcgtactccgaacggtggaattgacctgatcgcggaaacggtctatttctgattgaacctgttttcaacacgctattcggggtgacaatgactgtcaaagtaagtattgccatggtgtcaatcctccgtgacggactaagcaatggcgtcggcgtgaagtacaaacgcctcgccgaaggtgtcgctcaggccatcgatgagggtgtgatcgaggccggttgcaagttgccaccgcatcggttgttggccgacagcctcggcgtgaccatcggtacgatcagccgtgcctacggtgagctggaacgtgtgggattggtcgtcgcccgtgtaggcgatggcacttacgtgcgtcagcgcggtatggatcggccgcaggacaaaggctttcgcaatgtcagcgatgagccatccacctgcctggacatgagtcgaaatcaaccgatgcccggacaggaagccgaactcatgcgtcaaagtctgttggatctggccaacgagccagacgtcctgcggcaattgagtgggtacaccgctgaagccgggatggcacggcatcgcgtggcgggagcggtgtggctcagccatggcgaattcgtgccgcacgccgatcaggtgctgtgcgtcaacggtggtcaacatggtttgctgtgcgcgttgatggggctgctcaaggccggcgacacgctggtcaccgagcatttgtcctacccgggattgatcagtgtcgcccgtcagttgggcataagactgcttggcgcggcgatggatgacgaaggacttttgccttcggcgctggaggatgtctgccgtcagcatcgtgtttcggcgctgtattgcacaccgacaatccagaatcctacggcggcggtgatgtctgtcccacggcgcgaggcgattgccgaagtctgtcgccaacacaatctgctaatcatcgaagacgaagcgcatgccgtgctggatcgccaacggccgttgccgctgagttatttcgccccggagcgttcggtgttgatcggcagtttgagcaaagcggtttccgccggattgcgcgtcggttacctgcatgcgccgcaggcgttggtcgggcgtttgagtgcagccgttcgtgcgacgtgctggatggccaatccgttatcgatggaggtcgccagtctttggattgaaagcggcatggcccagcgcctgctggacgagcagatcagcgagatcgctcggcgcaaggccttggtggcgcctgttctgcagggcttggactacaagactcacccctacagtccgcatttctgggtgcaagtgcctgagctgtggcgggcgtcgcagattgcggcggagttgaaggagaacaattatctggtcgctaccgctgaggcgtttgcggtggggcatgcagcggtgccgcagttcattcgggtgagtgtgtgtaattcggtgggggatgatcggttgttgcttgcaggttttgaagctttaagtcaggcactgacagagacagtgtgatcgttcatcgcgagcaggctcactcctacaatgaatctctgtcgtccacatgatctgtgcccgctgaagatcaactgtaggagtgagcctgctcgcgatagcggtcgcacagacaccgcaaatctatttgaagcgccgctcgacacctttctccaccagaatcttcgccgaaatctcttccaccgaaaaatgcgtggagttgatgttcgggatgttctcgcggcggaacaggttctccacctcacgcacttcgaattcgcactgcgcgtagctcgaataacggctgttgggcttgcgctcattgcggatcgcggtgaggcgatcgggatcgatggtcaggccgaacagcttgtgctgatgggcgcgcagggcgttcggcagggtcaggcgttccatgtcgtcttcggtcagcggatagttcgccgcgcggatgccgaactgcatcgccatgtacagacacgtcggcgttttgccgcatcgcgacacgcccactagtatcaggtcggctttgtcgtaatagtgggtgcgcgccccgtcgtcgttgtcgagggcaaagttgaccgcctcgatgcgctccatgtaattggagttgtgcccgatcgaatgggacttgccgacggtgtaggaagaatgctcggtcagttcctgctccagcggggcgaggaaggtcgagaaaatgtcgatcatgaaaccattggacgttgcgagaatctcacggatgtcctgattgacgatggtatcgaagatgatcgggcggaagccgtcggtttcggcggctttgttgatttgttgtaccatggcccgcgctttttcaacgctgtcgatgtacggtcgcgtgaatttgctgaaggtaatgttttcgaactgcgccagaaggctttgacccagggtttcggcggtaatgccggtgccatcggagatgaagaaagcagatcgtttcatttgcaccttgggccttaagtgagtgtcctgtgttgcataggaatgccgatgtggcggcgcctgttgtcgccatactacgttgccgctcctcgccatagccagctatgacttgtcgcggcgccttgtctggcaacaacagtcactcgccacatcggcatgcctatgcaacacaggacacttatgagcattcttggatatgataggcgcgatttgttggccgccaatggccagcattctcacttattttccaggtccaggccatacaaccggccaaggctcccccgggccgccggtttctgagcttttccaacacagttagtggagagatcaccttggtagagtacgtagtttccctcgataagctcggcaaacacgatgttgagcatgtggggggcaagaacgcatccctgggcgagatgatcagcaacctggcaggcgccggtgtgtcggtccctgtcggctttgccaccaccgcccaggcctatcgcgacttcctcgaactgagcggcttgaacgaccagatccaccaggccctcgacgcgctcgacgtcgacgacgtcaacgccctggccaagaccggcgcacagatccgccaatggatcatggaagccgaattccccgaaaaactgaatgccgaaatccgcaccgcgttcgccgcgctgtcggccggcaaccctgacgtggccgtggccgtgcgttcttccgccaccgccgaagacttgccggacgcctcgttcgccggtcagcaggaaaccttcctgaacatccgtggtgtggaaaacgttatccgcgccgccaaagaggtgttcgcttcgctgttcaacgaccgtgccatttcctaccgcgtgcaccagggcttcgaccacaaactggtcgccctgtcggctggcgtgcagcgcatggtgcgttcggaaaccggcactgccggcgtgatgttcaccctcgataccgaatccggtttccgtgacgtggtgttcatcaccggcgcctacggcctgggcgaaaccgttgtacaaggcgcggtcaacccggatgagttctacgtgcacaagggcacgctggaggccggtcgtccggcgatcctgcgtcgcaatctgggcagcaaagccatcaagatgatctacggcgacgaggccaaggccggtcgttcggtcaagaccatcgacgttgaaaaggctgaccgtgcgcgtttctgcctgagcgacgctgaagtcagcgagctggccaagcaagcgatgatcatcgaaaagcattacggctgcccgatggacatcgagtgggccaaggacggtgacgacggcaagctgtacatcgtgcaggcccgtccggaaaccgtgaaaagccgcacccaggccaacgtcatggaacgttacctgttgaaagaaaccggcaccgtgctggtggaaggtcgcgcgattggccagcgcatcggcgccggtaaagtgcgcatcatcaaagacgtctccgaaatggacaaagtccagccgggcgacgtgctcgtatccgacatgaccgacccggactgggaaccggtgatgaagcgcgccagcgccatcgtcaccaaccgtggcgggcgtacctgccacgcggcgatcatcgctcgtgagctgggcattccggccgtggtcggttgcggcaacgccacccaactgctgaaggatggccagggcgtgaccgtgtcctgcgccgagggcgacaccggttacatcttcgaaggcgagctgggcttcgacatcaagaagaactccgtcgacgccatgccggagctgccattcaagatcatgatgaacgtcggcaacccggaccgcgccttcgatttcgcgcaactgccgaacgccggtgtgggcctggcccgtctggaattcatcatcaaccgcatgatcggtgtgcacccgaaagcgctgttgaactacgacggtctgccgcaggaaatcaaggacagcgtcgacaagcgtatcgccggttacaacgacccggtcgacttctacgtcgacaaactggtggaaggcatcagcaccctggctgcagcgttcacgccgaaaaaagtcatcgtgcgtctgtcggacttcaagtccaacgaatacgccaacctgatcggcggcaagctctacgagccggaagaagaaaacccgatgctgggtttccgtggcgcttcgcgttacatcagcgaatcgttccgcgactgcttcgagcttgaatgccgcgcgctgaaacgtgtgcgcaacgagatgggcctgaccaacgttgaaatcatggtgccgttcgtccgtaccctcggcgaagccagccaggtcgtcgatctgctcgctgaaaacggcttgaagcgcggcgaaaacggtctgcgcgtgatcatgatgtgcgagctgccatccaacgcgatccttgctgaagaattccttgagttcttcgatggtttctcgatcggctccaacgacctgactcagctgacattgggtctggatcgcgattcgggcatcatcgcgcacctgttcgacgagcgtaatccggcggtcaagaagctcttggccaacgcgattgccgcgtgcaacaaggccggcaagtacatcggtatctgcggtcagggtccgtccgaccacccggatctggccaagtggctgatggagcagggcatcgaaagcgtgtcgctgaacccggacaccgtactggaaacctggttcttcctcgccgaaggccaaaccccggcttgatcaacatgtgaacggaccgttcccctgtaggagcgagcctgctcgcgaagacggcataacatccgccataaatatcggctgatacaccgcaatcgcgagcaggctcactcctacaaggggcgggctttgagattgaagtagggcgagcgccttcggatgccgcccttttttgtgcaagagcattatgcaaagcagcagcaacctgtttcctgtcgccctgatcagcgccgaacggcgtggtgatctgagcgaagacgtgtatcgcctgaaacccggcaacagccccgactggtctgtggaaatcgctgtgacccgtttgggcatggctgatgactcgcagccacgcggcgtgccggtgattctgctgcacggcagtttttccaatcggcgcttctggttttcaccgaaaggtctggggctgggcgcgtatctgacgcgactgggtttcgacgtgtggattccggagatgcgcggccacggcttgtcgcagcgcaacgaggagtaccgacgcaaccgtgtcgccgattatgcccgttacgacttgccggcgattgctgcgttcgtgcgtgagcagagcgggcagattccgcactggatcggccactcgttgggcggcatcaccttggcggcggcactcggtggcgaataccttggcgagcctgccgtggcgtcggcggcgtttttcggcacacaggtcagtcgcacttactggccgttgaaaatcccaccggtggagtggagcggtcgcttcattctcaagcgttttgcgcagctgtcgggttcgcgcctcaagcgtggcccggaagatgagccgatcggtctggcgctggagagcatgcgctggtacggcttgttcggccgttttggtgacaaggacaaggattggtgggcagggctggctgatgttcaggtgccggtattggcggtgagcgcggcgggtgatcatcaggatccgacttgggcctgccgcaagttgttcgaacagattggcgccgaacacaagcagttcatcaatctgggacgtgatcagggcttcaacgacaatttcggccatgttgaaatgctggtgagcaaagcggcgcaggttgaagtgtggccgttggtggcgcgctggttgagcgatcagcagacaccgttgctgggtgacaagccggatctggccgcagcagtctgaagtcgcgccgctgaaaagggcgtttcgttcggattggcttgcggctaagatatgacgcattgtgcggttctggtcatttttggtggctgtttagctattacgtttcagcgtttgttcaggttcgttcagcgaccatgggatggactaaggtaaacagcgtccgccggatctcgtctcaacagaatgcgtcatccttgatcgtcttccttgttacaggagtttttcgatgaaccattacctcacgcctgacctgtgcgatgcctatccggagctggtgcaggtgctggaaccgatgttcagcaatttcggcggccgtgattcgttcggcggcgaaatcgtgaccatcaaatgcttcgaagacaactctctggtcaaggaacaggctgacctcaagggcaacggcaaggtgttggtggttgatggcggcggttctctgcgcagggccctgttgggcgacatgattgccgagaaggccgccaaaaacggttgggaagggctggtgatctacggctgcattcgtgacgtcgacgtcatcgcgcaaaccgatctgggcgtgcaggcactggccagccacccgatgaaaaccgaaaaacgcggcctcggtgacctgaatgtcccggtgactttcgccggcgtgacgttccacccgggccagtacatttatgcggataacaacggcgtgatcatctcgccgagcccgctgaagatgcctgaataagcctttcgacaaagggatgcggatgttcgaggaagaaaacgcgcaatgggggctggtgcatgccctggtgctggacggaaaaggcggtgcgcgttcgatagcccggactgagctcgacgatttgcggctgcaggcccatgaaagcctgtggctgcattgggatcgcagtcatccgcagacccagacctggctgcgcaaatccagcgggctcaacgaattcacctgcgacttgctgctggaagagaacacgcgaccgcgtttgttgccgctgccggattccgagctgctgctgttcctgcgcggagtcaatctcaacccgggcgccgagccggaagacatggtctcggtgcggatttttgcctccgcccaacgcgtcatctctttgcgtttgcgtcctctgcgtgcaacagatgagttgctggcgcaattggcggacggcaaaggcccgaaaacggcgtctgaactcattctttatctggcgcagttcctcaccaacaaggtgcaggatctggtcacttgcctctcggaaatcgccgatgaagaagaagaaaagatggatgccgacgaacggtatacccccgagcatggggccattttgcacatccgccgcagggccgccgggctgaagcgttttctcgcaccgcagcgggatattttcggtcaattgacgcggatcaaaatgccgtggttcgtcgatgacgatgccgattactggaacgaattgaacaacagcctgacccgctatctcgaagaactggaattgacccgagagcgcgtggggcttgtgctggaggctgaagaccggcgtttgagcgagcgtatgaatcgcacgatgtaccgtttcggcatcatcacctgcatctttctaccgatgagtttcatcaccggtttgctgggtataaatgttggcggaattcccttcgccagcagcccttatggtttcctgatcgcctgtttgacggtgctcgccctggccttcggtcagtggtggttatttcgtcgtttgcgctgggtctgaacatggcgcatgtgacccgaccaaatctgcccgcgtctttcacagacatcacgagaggtgcgtatgcacgatccgtttgaacagtctttgcgcgacatgctcaacgcttcgccgtccagccgcgacgacgatgcctgcctgggccgcgtactcaaaaccgccaaccgccaggttggcgccggtgatctgttcagcctgctgggccgttggctgcccgcgctgatgattgccctgaataatggatcggcgcatgtttcgccggtttcccgtcttcgtaaacctaccgctcgcactgctgataaggctgattgaatatggaacttgacctctggactcagagcctcgtcactgcaatgactgcgttgtggaccaaagtagccaacttcattccgaacctgttcggcgcgctggtcgtgctgctgttgggtttcgtcgtggccaagctgctcgataccttgctgtccaagctgctcgccaaactgggcctcgatcgtctgatgggcggcaccggcctgaccaaattgatgtcgcgagccgggctgcaagtgccgatctcgaccttgatcggcaaaatcgtctattggttcgttctgctgatatttttggtttctgcagcagaatcccttggacttgagcgagtttcagctacgctggatatgttggcgctgtatttgccgaaagtattcggcgcggccctggtattgctggtaggtgttttgctcgcgcaactggccaacgggctggtgcgcggggcggcagaaggcgtaggcctggactacgcttccgggctgggacgcattgctcaggggctggtgatcatcatcagcatctcggttgcgatcagtcagctcgaggtcaagactgacctgctgaaccatgtgattgtcattgtattgattaccgttggtctggcggttgcgctggccatgggtttgggaagccgggaaattgccggtcagattcttgcgggaatctatgtgcgtgagttgtatcaggttgggcaacaagtgcgtgttggcgaggtcgaaggccagatcgaagagatcggcacggttaaaaccacattgctgaccgatgagggtgagctagtctctctctccaatcggatcctgctggaacagcatgtgagtagccgctaatccggcaaaccctgctaatgtatcccgccgcaaaatgccagctgatgctggttgcggtggacattgacctgactgtcggcacgacttgttttgaataaagcccaaacgctatctacgcgctacgacccccgcgagctctctgatgaggagttggtcgcgcgctcgcataccgagctgtttcacgtgacgcgcgcctatgaagaactgatgcggcgttaccagcgaacattatttaacgtctgtgcgagatatcttgggaacgatcgcgacgcagacgatgtctgtcaggaagtcatgttgaaggtgctgtatggcctgaagaacttcgaggggaaatcgaagttcaagacatggctatatagcatcacgtacaacgaatgtattacgcagtatcggaaggaacggcgaaagcgtcgcttgatggacgcattgagtcttgacccccttgaggaagcgtccgaagaaaaggcgcccaaacccgaggagaagggcggacttgatcgctggctggtgtatgtgaacccgatcgaccgcgaaattctggtgctacgatttgtcgcagagctggagtttcaggagatcgcagacatcatgcacatgggtttgagtgcgacaaaaatgcgttacaaacgtgctctagataaattgcgtgagaaatttgcaggcattgctgaaacttagttcagcgcaaatatctcttacgtgtaggcaagttctgatagacttgccgccgagttgtcccccggtttgcgggactgcttcacaatcaccagatggggatttaacggatgaaactgaaaaacaccttgggcttggccattggttctctgattgccgccacttcgttcggcgctctggcacaaggccaaggcgcagttgaaatcgaaggcttcgcaaagaaagaacaattcgacagcgctcgtaacttcaagaacaacggcaacctgttcggcggttcgatcggttacttcctgaccgacgacgttgaactgcgtctgggctacgatgaagttcacaacgtacgtgccgacgatggcaagaacgtaaaaggcgctaacaccgccctggacgctctgtaccacttcaacaacccaggcgacatgctgcgtccatacgtctcggccggtttctccgaccagagcatcgaccagaacggttcgaacggtcgtaaccgttctaccttcgctaacctgggcgctggtgccaagctgtacttcaccgataacttctacgctcgtgctggcgttgaagctcaatacaacatcgaccagggcgacaccgagtgggctcctagcgtcggtatcggtgtgaacttcggtggcggctccaagcctgctgctgctccagttccagcaccagctgaagtctgctccgacagcgacaacgacggcgtttgcgacaacgttgacaagtgcccggacaccccagccaacgtaactgttgacgctgacggctgcccagcagttgctgaagttgttcgtgttgagctggacgttaagttcgatttcgacaagtctgttgttaaaaccaacagctacggcgacatcaagaacctggctgatttcatgaagcagtacccatccaccaccactactgttgaaggtcacactgactccgtcggtcctgacgcttacaaccagaaactgtctgagcgtcgtgcaaacgccgttaagcaagttctgaccaaccagtacggtgttgaatcgtcccgcgttcagtctgttggctacggcgaatcccgcccagttgctgacaacaaaactgaagctggccgtgctgttaaccgtcgcgtagaagcgcaggttgaagctcaagctaagtaattagctgccgctccgagaaaagcccggcttaggccgggcttttctttgtctgcgatttggctttgaagctttaaaagaccgcagccttcagcagctcctacatgaattctgcatacgtcctgtaggagctgccgcaggctgcgatcttttgctcttcaacaacagccgccaccgcaccaatcaccagaatcgccgggcttcgcaatccgaaaacacctgcgtcatcactcatgcccatcagatcactccgacattcgcgctgctgcggcagtgaagcattctcgatcatcgccaccggcgtatctgccgccatcccgcccgccaacaactggtcgcgaatctcgcccagttttgccacgcccatgtaaatcaccagcgtcgtgccaccctgcgccagcgcctgccagttcaattggctgtcatcctgggtgtgcgcagtcaccagcgtcacgccacgcgcgaccccgcgcaaagtcagcggaatatcacactgcgtcgccccggccagcccggcagtgatgccattgaccagctccacctcaacccctcgctcacgcagccactgcgcctcttcaccgccacggccgaaaatgcacggatcgccgcccttgagccgcaccacgcacttgccttggcgggcgtaacgcagcatcagtcgatggataaacgcctgcggagtggaacggcaaccgccgcgtttccctacggcaataatgcgcgcgccggggcagtgctccagcaccacgtcgttgaccagatcgtcgatcagcaccacatcggcttcgcgcaaggcgcgcactgctttgagggtcaacagttccggatcgccggggccagcgcccaccagccagacttttgcattcatgggtttttcctcatcagatgacggcgactggttgcacatcggcagccagcaagcgttttatttccgggacacaggagccgcattgcgtgccgcagcccagattgtttttcaagccttgcagatccagcccttggcgaatgccggcgcagaccgcgttgaggctgacgttgttgcagttgcacagggttttatccgcagcgatctgcgccccggcgctacccggcggagtactcatcggtgccaacaaccagcgccgcagttgttcgtccgcacggccctccagccacaacccttgcagccaatgccgggcgagggtttcgccggccaggcgaatcgcggtgatccgcccgttttcaatgcgcacgcgcttgccaattgaccggcgcgggtcgtcgtaggccaataccggaccgtcgatcagcgacagacactggtcgatttcaccgagcaattgcggattcggcgcctcgctgctggcagcgcgtatcagcaatgccggtcgctcacgcccgacaaggctgagactcacgtaggaaaatgcctcacacaacggtcgtagggtctcgaaatgctgttgaacattgccttcgatgagtgcgaacaattgccacggcagattcaccgcttccaggcgcacgccgctgtgtttgagttccggttgtttcgacaatggatcgaaggccggtagggtcaggctgttcacgccgcccttgagaaaacggtcgccccagtgcatcggcagaaacgcctgtcccggacgcacgctgtcgtcgctgccaaccgcgacgatcactgcgccgcgacgacttttaaggttgaccagatctcccggctgcaagcgatgcctgcgcagttcgtccgggtgcaagctcaacaccgcttcgctgacatgcccgaacaactgcgccgccgtaccggtgcggctcataccgtgccattgatcacgcagacgtccagtgatcaatgtcagtggaaaacgcgcatcgcgctgttctttggcggcgcgataagggtcggctatgaattgcgcgcgtccgttggcggttgggaaaatcccgtcctcgtacagtcttggcgttccttgccgcgcgccgacagggaagggccattgctgcggtccgatctcgtcgatcagcgcatgactgatcccggacatatccagatcccgcccgtgcgtcagccctttgaattcatcgaacaactgcgcaggttggttaaaggtaaacaggctagattcggcgggacgcagacgtttctccagacgttgtgcgaaatccaccgtgatcgcccaatccggacgcgcttcaccgggtgggagaatcgctttgcgtacgtgggaaatgcgccgctcggaattggtcaccgagccttccttctcgccccaactggctgcgggtagcagcagatcagcgaatgccgcggtttcagtggtgcgaaaggcttcttgcagaactacaaacgggcaggcctcaagcgctgctcgtaccgaatgttgatccggcatcgattgcgcagggttggtgcaggcaatccacaacgccttgatcttgccgctgcgcacctgctcgaacagttcgatggcgctgaggccggtactctccggtagccgatccacaccccagtaagccgcgacttcggcgcggtgttcagggttggccgcctcgcgatgccctggcagcaaattggacaagctacccgtttcgcgtccgcccatggcatttggctgacccgtcaaagagaaaggtcctgcacccggccggccgatttgcccggtggccaggtgcagattgatcaaagcactgttcttcgcgctgccggccgtggactggttcaaacccatgcaccacagcgacaggaaacttggtgaagtccccacccattcggcgcactgctgcaattgctcgacgctgatcccgcacagttgcgaaaccatttgcggggtgtaatcgcgcaccagatttttcagttcagccaagccttcggtgtgcgctttgatgaagtcgcgatcaaccctgtcttcccacaacagcagatgcaaaatcccatgaaacaaagcgacatctgtgcccggcagaatcgccaagtgcagatcggcgaggtcgcaggtgtcggtgcgccgtggatcgataacgatgactttcatctgtgggcggcgggattttgcctcttccagccgacgaaaaagtaccggatgggcgtaggccatgttactgccgacgatcatcacgcaatcgctgagctccaggtcctcatagctgcaaggcggcgcatcggcgccaaggctgcgcttgtagccgaccaccgccgaggacatgcacaggcgtgaattgctgtcgatgttgttggtgccgaccagcgctcgcgcgagtttgttgaaggcgtagtaatcctcggtcagcagttgcccggagatatagaacgccacgctgtccgggccgtgctcggcgatggtttcagcgaacacgttggcagcatgttcaagcgcggtgtcccaatcggtgcgactgcgcgccaggcccttgcccagacgcaattccgggtacagcgcgcgggccgcgaggtcgccggtcaggtgcagggtcgagcctttgctgcacagtttgccgaagttggccggatgcgccggatcgccgctgacgccgaggatgcgctcgccgtcatgctcgatcagcacgccgcagccgaccccgcaataacagcaggtcgaggcggtcgtctggcggctcatcagatggcgtcccgcagagccagctgcacgcgcccgttttcgacccgcgccgggtgatggtgcgcgcaaccgatgtctggcgcctgcgcttcgccagattcgaggtcgatctgccagttgtgcagcgggcaggcgacgcgtttgccgtagatcaaaccttgcgacaacggcccgcccttgtgcgggcagcggtcgtcgagggcgaaaacctcatcgtcacttgtacgaaaaatcgcaatgtcacctttcggtccggcaatgattcgcgaaccgagggcattgatctcgtcgagggcgcagatatcgagccagttcatgccggcacctccaggtttttcacggggatcacatcgaattctttcttcagttgcggctgcgccagacgttctttccacgggtcttgctcaaatgacagggagaactgcaggcgttcgttcagggctttgcggcgttccgggtcttccagcacggctttcttgatgtgttccatgccgacccgttgcaggtagtgcacggtgcgttcgaggtagaaggcctcttcgcgatacagctgcaggaacgcaccgttgtattcgcggacttcttcggcggttttcagcttgacgaaaaattcggcgacctcggttttgatcccgccgttgccaccgatgtacatctcccagccggagtcgacgccgatgattcctacgtctttgatccctgcttccgagcagttgcgtggacatccggaaacagcgagtttcactttgtgcggtgaccacatgttgaacaggtcgtgctcaagctcgatgcccagttgtgtcgagttttgcgtgccgaagcggcagaattcgctgccgacgcaggtcttcacggtgcggatggatttgccgtaggcatgcccggacggcatgtcgaggtctttccagacgccgggcaagtcctgcttcttgatgccgagcaaatcgatgcgctgaccgccggtaaccttgaccatcggcactttgtacttgtcggccacgtcggcaatccgccgcagttccgaaggattggtcacgccgccccacatccggggcaccaccgagtaagtgccgtccttctggatgttggcgtgcgcgcgttcgttgatcagtcgcgattgcgggtcgtccttggcttcgccgggccaggtggaaatcaggtaatagttgagggcagggcggcaggtggcgcagccgttcggcgtgcgccagttgaggtagctcatggtgccggcgatggtcagcagatgctgctcgcgaatggcttggcggatctggccgtgattgaggtcgctgcaaccgcagatggctttttcgcttttcggtttgacgtccgccgcgccgccgacggtgttgatcaggatctgctcgaccagcccggcgcaggagccgcaggagctggccgctttggtgtgtttcttcacctcatcgacgctgaacaggccgtgttcctgaatcgctttgacgatggtgcctttgcacacgccgttgcagccgcagacttcggcggtgtcagccatgaccatagctttgtcctggccctgatgtcctacgtcgcccaaagcattttcgccgaacatgaggtgatcgcggatctcgccgatggcgtgattctcacgaatctggcggaaataccaaccgccatctgccgtatcgccgtacagacaggcgccgaccagcacgtcatccttgatcaccagttttttgtacacgccgccaatcgggtcggatagggtgatggtctcggtgccttcgccgcccatgaagtcgccagcggaaaacaggtcgatgccggtgactttcaatttggtcgacgtcaccgagccctgataacgagcgaaacccaattgggcgaggtggttggcgcacaccttggcctgttcgaacagcggcgcgacgagaccgtaggcaatcccgcgatggctggcgcactcgccgatcgcgtagatgcgcggatcgtaggtttgcagcgtgtcattgaccagaatcccgcgattgcacgggatgccggccttctcagcgagttcggtgttaggacgaatgccggcggccatcaccaccagatcagcggggatgatgtcgccgttcttgaattgcaccgagccgacccggccattgccggcgtcgtgcaaggcctgggtctgttcgcacagacggaagtgcaggccgcgggattcgagggcgctttgcagcagttggccgctggtcttgtccagttgccgttccagcaaccattcgccgatatgcaccacggtgacgtgcatgccgcgcagcatcaggccgttggccgcttcaagaccgagcaggccgccgccgatgaccaccgcgtgtttgtgggttttcgcggtgtcgatcatcgcttgagtgtcggcgatgtcgcggtagccgatcacgccgtgcagagtgttgccggggatcggcaggatgaacggtgtcgaacccgtggcgatcagcaggcgatcgtattcggcctcggtgccatcctcggcgatcacccggcgtttgacccgatcgatctccaccactttgcggttgagcaacaacttgatgttgttttgcaggtaccagtcgagatcgttgagcacgatttcttcgaaggtctgctcaccggccagcaccggcgacagcaggatgcggttgtaattggtgtgcggctcggcgccgaagacggtgatgtcgtacagctcgttgctcagcttgagcagttcttcgagggtgcggaccccggccatgccattgccgatcatcaccagtttgagttttttcatcaggttctccggggagctgcggctggcctcttgtgggcagtcaggccttgctcgagaaattttgcgcaaacaaaaaaggcgtcccgctagttgcctagcgaggacgcctttgtcctggtcccgttctctcgggaagcgcagccttcgtcgttgaaggctgggctttatgtgtgtgttgagaggggtaatgcagtggttgtgccaagtggggacggtggcgggtttattgggggcgagggattttgaggatggattttgtgcactgattcgaagcgggttgctcgttcgtggggcattcaggcagataaatttgtggtgattgggctgacgtcatcgcgagcaggctcactcctacaggggaacgcatttcaaatggtaggagtgagcctgctcgcgatggccgcgacgcggtgtcagtgatgaaacaacaaaaccagcagcaccagattcccaagcaaagccaccaatgccatcgtccgccagaccttcagcggctcgcgctccagcaagggccgaggccgcacactcaaactgcgccgctcaccctgttccagcaccagcaaccattcctcagccgtttcaaaccgttgttgcggatcagccgccaccccgcgctcgagactctgcgccagccagtccggcagatcgggccgatagcgactggcgctcaccgcgacaccaaatcgcggccgctgaaacgcttcgatctcgccataggggaaatgcccggtcagcaggaaatacagggtcacaccgaccgcatacaaatcctgctgcgcactcggcggatcaccgcggaacgcttccggggcgatgtagctcggagtgcctggcagtgtcgacggcgcgtcttcggacaaccccgggcaatacgccaggccaaaatcgagcaggcgcaattcaccgtcgtcaccccaatgcagattctccggtttgatatcccggtgcagaatctgccgccgatgcagcaggccgaccgcacgcagcaggcgttcggcgaggtcctgccattgcgccaagggcaaaagctcgagctgtgccagagtccttccggaatattcccgcatcacgtagtacaaatgctgacgctgctggcaggcatggacttcaggaaagtggcgaccggctacgcgtttcagaaaccattcctcggacaacagcgcttgcccggcgtaggaatcatcggcggaacgcgtgggtagggttttcagaagccacgtctgaccttgtccatcaagcacccgatacagcagcgattgctggctctgagcgacaacgtccagcacttgccagccttcgaacgactgaccgggtttcaacggtggcggcaggggccattgctgcaaatgaatcagcgcatcgccgatactggcctcacccaaagcatccacccgcaccagcaaagcactggcattgtcctggctccccgccagatgcgcggcgttgaccagcgtctgcgctgcgctgcgcagatccggctgatcacgcagaatcgccgcaatcgcggtatcgcccaacgtcgaccagaccccgtcgctgagcagcacaaagctttcgccgtcacgcagttcgccgtcgaggaaatccagcaccagatgctgatccagccccagcgcacgtttgagcacatgctgcatgcccggctgctcccagacgtgatcttccgagatccgctgcaagcgctcggcgtgccagcgataaacccggcaatcgccgacatgggcgagggtaaagcgccgaccacgcatgaccagagcactgaccgtggtgagcagcggttgcccaccgccattggcctgcagccagcgattttgcgcgagcagcaggcgatccagcgcctgcgccacgctccaggtttccggtgtggcgtagtagtcgagcgccagcgcctgcaacgtcgagcgcgcagccagtccgccatcggcgcactggctgacgccgtcggcgatggcgaacagataacccttgcttgccgccaacgccggagcgggcgtgaccaggcgcaaagcgtcctgattctccgcgcgcgggccggtggcgctggcttcggcaaaactcagttgcagggccattgatgcttcagacccgcgccgccgtcaccgctgccgagccccaggtggttctccagcgacgcttgacgccgtgcaggccaaaccacgccaatacgcccaggctggcgaacaaccacagggccagttgatagctgccggtgctctgtttgatcgcgcccatgccagcggccaaggcaaaaccgccgatgccgccggccatgccgatcagtccggtcatgacgccgatctcgagacgaaaacgctgtggcaccagttgaaaaaccgcaccgttgcctgcccctaaaccgagcatggtgcagacgaaaagggcgagtgccgcgtaggaacttggcaggttgaagccgacggcagcgatgcagatggcggcaacggtgtacatcgccagcagcgtgcggatgccaccgaagcggtcagccagtgcgccacccagcggccgcatcagactgccgccgaacacgcaggcggcggtgtagtaaccggcagtcaccgggctcaggccgtattgatcgttgaagtagccgggcagggcgctggccaggccgatgaagccgccgaaggtcacgctgtagaaaaacatgaaccaccagctgtcacggtcgcccaaggctttgaagtagtcagtcatggctttggcttttggccgttctggcgcgttcttcgccagccaggcgaacagcaccagcgtcaggatcagcgggatcagggcgaaaccgaagacattgctccagccgaacgcggcggcgagtaccggcgccagcagcgcggcgaacacggtaccggagttgcccgcaccggcaatgcccatggctttgccctgatgctgtggcggataccattgcgaagccagcggcagcgcaacagcaaacgacgcgccggccatgccgaggaacaggccgagtaccaacgcctgctcgtagctatgaatgccgattttccaggcaccgaacagcgcgcaaatcacaatgacctgaccgatcagcccggcggttttcggtgagagccgatcggcgagcatacccatcacgaagcgcagtacggcaccggcgaggatcggcgtggcgacgacgaggccacgttgttgcgtggtcaagtgcaggtcggcggcgatctgcaccgccagcgggccgagcaggtaccagaccatgaaactcaggtcgaaatagaggaaggccgcgaacagggtcggggtgtggccggatttccagaagcttgaattcatcgcgcacctcagctgaaaagagtctcgaaaggagtcatgcaacagcaggtggggcgccgccacggccgcaccaccggccccgagctgtggggccaaaacgcaaaaacgccgctacctgatgcgccggttgggcgaacgggtgagcgacgtctttgtcgtgggtggggcaaccgccgttggttacctgtgcgttttacatagctagatttgtgccaacagcctgaaaatcaaaagcccctcaccctagccctctcccagagggagaggggactgattgggggatgctcgagaagtacgccgacctgtgattttctgctgtgaatccataatcgactcggtctttcaggtcgatgtttgacgccagacacctaggtcggtcccctctccctccgggagagggctagggtgaggggcttttcaagcggtcattactttcagccaagcaactcactcatcgcaataatctgctccgccacctgaatcagcttctgctgccggctcatggcctggcgccgcatcagggtgtaagcctcttcctcattgcagtccttcatcttcatcagcaaccctttggccagctcaatgcgcttgcgctcagccaattgctggtcacgcgcgtgcagctgcgcacgcaacgcctgatcactctcgaaacgcgccatcgcgacatcgagaatcggctgcaaacgctgggcgtgaatgccttcgacgatgtacgcgctgaccccggacttgatcgcctggcgcatcacccccggatcatgttcatcggtaaacatcacgattggccgaggttggtcgcggctgaccagtaccacttgctccatgacatcgcggctcggtgactcggtatcgatcaggatcacgtccgggcgcaccgtttcgacgcgcgcgggcaggtcgatggtcagcccggattcgtcgattacttcgaaaccggcctcggtcagcgcggctttaaggcgtccgacttttttcgctgtgtcgttgatcaacagaatgcgcaacatgttcgcggtctcctgtcagcggcgggcgagaaggggagcatcgtcgctcaacgcgtgcagcttgaaactgcgcgcataaccagcgggatcgctgccgtcccagatcttgccgtcgagcaactggctgctgcgcatgtcgctgccccacgcggcaacgccgagcgccgtggcggcctcgcgatagagatcaagctgctgaacctggcgggcgacggcgaggtaatccggatcttcacgcaacaagccccagcggcggaactgggtcatgaaccacatgccatcggacaagtacggcaaattcacttggccattgccgtgaaaacgcagcgcgtgcggatcctgccaacgattgccgaggccatcggcatagtcaccgagaaaacgtggttcgatgcaggccagcggagcatcgagatactccggcgcactcagcaattgcgcggtgctgcggcggttctccgggctttcttcgatgaaacggctggcttcgaggatcgccatcaccaacgctcgcgcagtgttggggtattgctcgacaaattcgcgggtgcagccaaggactttttccgggtgatcgggccagatggtctggctggtcgccaaggtaaacccaagatcctgctgcaccgcgctggccgcccacggctcgccgacacagaagccatcaatgcgcccggcctgcaagtgcgcgaccatttgtggcggtggcaccaccacgctgtcgacatcctgaagtggatgaatgccctggctcgccagccagtaatacagccacatcgcgtgcgtgccggtgggaaaggtctgggcgaaggtcagttttgcgcggctttggtgcacgtggcggtccagcgcttcaggactggtcacgccgaggtgttgcaggttgtgggacacattgatgctttgaccgttttgattgaggcccatcagcaccgccatgtcggtcggagcgacgcccccaatgcccagatgcacggcgtaaatcaatccgtacagactgtgcgccgcgtcgagttcaccgctgaccaggttgtcgcgcagattggcccaggatgcctggcgcttcaggttcagcgttagtccgtaaggctgggcaaagccttgagtggcagcaacgacaaccgacgcgcagtcgctcaacgccatgaagccgaggttgatcgcagttttttccggggcatcgctgccattgacccaggccagtggccctaccgaaggttcattcatccaacgctacctcgaaaaaaagcgtcgccacggactttgcgcaggcaaaatccgggacgacgccattgtccttgcccgcctgccttcattggcctgcgcgctgatagcgaagagggtgcaaggcatatgccagtgccagtgatttgcgcgtgcgcctcgcgcggtgggtcgttgcccggctataatcgccgcctcttttcgccgcccgagtcatcgccgcccatgtacaccctggcccgtcagctgttgttcaaactttccccggaaacctcccacgatctgtcgctggatctgatcggcgcgggtgggcgtttgggcctcaacggcttgctgtgcaaggcgccggcgaagaagccggtgacggtcatggggctggagttcccgaacccggtggggctggcggccggtctggacaagaacggcgcggccatcgatggcttcgcacaactgggtttcggttttgtcgaaatcggcaccgtgaccccgcgtccgcagccgggcaacccgaagccgcggatcttccgcctgccggaagccgaagcgatcatcaaccgcatgggtttcaacaacctcggtgtggataacttgctggcgcgggtggcagcagcgaaatacaaaggcgtgctgggcatcaacatcggcaagaacttcgacacgccggttgagcgcgcggttgacgactacctgatctgcctggacaaggtttacgcccacgccagctacgtgacggttaacgtcagttcgccgaacacgccgggcctgcgcagcttgcagttcggtgattcgctcaagcaattgctcgccgatctggctacgcgtcgtgccgaactggccttgcgtcacggcaagcacgtgccgctggcaatcaagatcgcgccggacatgaccgatgaagaaaccgcgcaggtcgcgcaagcgctgatcgaaaccggtatggacgcggtgatcgccaccaacaccacgctgagccgtgtcggcgttgaaggcatggagcatggcgacgaggcgggcggtttgtcgggtgcgccggtgcgggagaagagcaccaataccgtgaaggtgctggccggtgagctggctgggcgtttgccgattattgctgctggcgggattactgaaggcaagcatgctgcggagaaaattctcgcgggtgcgagcctggtgcagatctattcgggcttcatctataaaggcccggcgttgattcgcgaatcggtcgacgcgatcgccgccctgcgctgatccatagacaccactgttcccttgtaggagtgagcctgctcgcgatagctttctttcggtcacttcatcagcgactgacagaccgctatcgcgagcaggctcactcctacaggttatgcgctcggcacaaaaaaccatgcaataaaaagggctcctcgaaggagcccctgggccgtagcccgccgtccgggaaggacgtgcgtggttaatttgttacaaattcagattgtcgtgtcggaataaatgccctgtgtcagccgacggcgtgaagttcgttgagtctgtggattcccgcagtgccggtcataccgtcccagttgtcgccgcgtccttctcgccagccgttaatccaggcttgacgtaccgacggtagagtaaatgggcaaagctcacgggatttgccaccaacgccatattgatatccgcgcaaaaatgctctttccaacggatcacgcttaagtcttctcatagggtgtttccctcacttgttgactgttttgtgtcgcgttgacctcaactgaggtctggcagaaaaaacctgccatggtgcggctcgctgccggcgtggcgagccaaggtgttgacgccgttgcgacgtcaacctgtgctcagttctaaccaatgagtcacagcgatggaatgaccgttttgtcataaggacgtaacgaaaagagtgctatagcgataagtaactgcgtatttattgaatgtttattgggcaaaccccggtatgatcggccccgcgctggatgatggggttaattctttagtgagaatgacccacgtttgcgctggggtactattcgacgaagggtcgttttaagactttttgttgcatcaacttttttatctgtcctggcatctaagctcttttaacccgagcagcggggatggaacggcacaccttcgtgccacgcgggcgctctttaagaaaagcgcctgattgaaaaccggatcggcaatgcgttgccgattcactagccaaaggctctggaaataccatgtccgaccgtttcgaactcttcctcacttgccctaaaggccttgaaggcctgctcatcgaggaagccgtcgggcttggccttgaagaagcgcgcgagcacacttccgccgtgcgtggcatggcgtccatggaaaccgcttatcgcctgtgcctctggtcgcgtctggccaaccgggtgctgttggtgctcaagcgtttcccgatgaaagacgctgaagacctctatcacggcgtgctcgacatcgaatggcaggatcacatgctcagcgacggcaccctggccgttgagttcagtggtcatggctcgggcatcgacaacacgcatttcggtgcgctgaaagtcaaagacgccatcgtcgacaaattgcgcaccccgcagggcgaccgcccgtcgatcgacaagctcaaccctgacctgcgcatccacctgcgtctggatcgtggcgaagcgatcctctccctcgacctttccgggcacagcctgcaccagcgcggctatcgtttgcagcagggcgcggcgccgctgaaggaaaacctcgcagcggcgatcctgatccgttccggctggccgcgcattgccgctgaaggcggcgcgctggctgacccgatgtgcggtgtcggtacgttcctcgtcgaagcagcaatgatcgccgccgatatggcgccgaacctgcgtcgtgagcagtggggtttcacggcctggctcggtcacgtgccggcgctgtggaaaaaactccatgaagaagccgtcgaacgcgccgctgccggtctggccaagccaccgctgtggattcgcggttacgaagccgacccgcgactgattcagcccggccgcaacaacgtcgagcgcgctggcctcagcgaatggatcaagatctatcagggcgaagtcgcgaccttcgagccgcgcccggaccagaaccagaaaggtctggtgatctgcaacccgccgtacggcgagcgtctcggcgacgaagccagcctgctctatctctaccagaatcttggcgaacgcctgcgtcaggcctgcctgaactgggaagcggcggtgttcaccggcgcgccggatctgggcaagcgcatgggcatccgcagccacaaacagtattcgttctggaacggcgcgttgccgtgcaagctgctgttgatcaaggttctgccggatcagttcgtcaccggcgagcgtcggaccccggaacaacgtcaagccgagcgcgagcaagcggcttacgatctgactccggacgagccgcaagagcgcaagttcaacaagaacggcaacccgatcaaaccgacgccagccccggcgccggtgatcgagcagccgcgcttgagcgaaggcgggcagatgtttgccaaccgtctgcaaaagaacctcaaggcgatgggcaagtgggtcaagcgcgaaggcatcgattgctaccgcgtctacgatgccgacatgcctgaatatgcgatggccatcgacctgtaccacgattgggtgcacgtgcaggaatacgccgcgccgaagtctatcgacccggaaaaagcctcggcgcgcatgttcgatgcgctggcagcgattccgcaggcgctcaacgtcgacaagagccgcgtggtggtcaaacgccgcgagcgccagagcggcaccaagcaatacgagcgtcaggctgcgcagggcaagttcaatgaagtcagcgaaggcggcgtgaagttgctggtcaatctcaccgactacctcgacaccggcctgttcctcgatcaccggccaatgcgcatgcgcatccagaaagaggccgccggcaagcgcttcctcaatctgttctgctacaccgcgaccgccagtgtgcatgcggccaagggcggcgcgcgcagcactaccagtgtcgacctgtcgaaaacttacctcgactgggcgcgccgcaacctgtcgctgaacggtttctccgacaagaaccgtctggagcagggcgatgtgatggcgtggctggaaagcagtcgtgacgagtacgacctgatcttcatcgatccgccgacgttctccaactccaagcgcatggaaggcatcttcgacgtgcaacgtgatcaggtgcagttgattgacctggccatggcgcgtttggcaaccggtggcgtgctgtatttctccaacaacttccgcaagttccagttggaagaaaacctcgccgagcgctacgcggtcgaggaaatcagcgcgcagaccattgatccggattttgcccgcaacaccaagatccaccgcgcctggaaaatcacggctcgttgacgctttgccgggttggatccacagagccttgatttttaaaggctccgtggatctgcccgcgctagctaaattagtggctaatagctataactcacacacggtcaatggggttttcccgtgaatgctggcgtagtgtgagttgtctttatgtcgttgcaccccgtgcgccctaagattctgggttttatcagcgaagacgtctcggcctggctggtcgcgatgctggtattgctcgccggtgcaattctcacggggttactcgcttgggcgaccctcaatcagtttcagcaacaaacgcgtcagcgcttccaactgctggccaacgaacgttacagtcgtatcgaagaacgctttcaggatcaggaacagcgcctcgatggtctgcggcgcttctttgccaactctgaatcggtgtcccgcgccgaattcgacggttacacccaacctttactaatgcgtacccaggcctactcgtttgctctcaaggtcagcgggcccgagcgcgccgctttcgagcagcgggtgcgtgacgaaggcttgagtcacttcaccctgcgagaattgaatcctcaaggcgaactgcaactggctggcgtgcgcgatgaatacgtgccggtgctcttcagccagacgcaaagccggcttggttcaccgctggggtacgacttgctggcgcagccgttgcgccgcgacaccctgcaacgtgccgacaagctcggcagtctggcggtgtcgcagccgatgcacctggtcagtatcgagccgtcctatgcgcgtggcgtgttgttggtggcgccggtgagccgcaatggcgagcgccaatcgttcggctacgtgatggcggtgatcagcatgcgccagctgctcgccgacggtttgccggatgccttccatgactacctgtcggtgcgcattctcgacatgtcgacccatgatcagcacgaggtgttgttcgaatcgaccaacgagccggcgccgagcgacttgtccgccacgcgcctggtacgcatggccgatcacgactatcaggtcgatatcttgccgagcgacgccttcgttcaggctaaccattcgtcggttggtagcgtgatcattctgggtggcttgctcagtttgctgctcagcgccttgctctacgtgttggtcagtcagcgtcagcgtgccttgcgtctggttcaattgcgcacccaggaactgcatgcaagcgaacaggaactgcggggcacccatggccagttacgcggcgtgctgaatgcggcgacgcaggtggcgatcatcgccaccgacctgcgcggcgtgatcaacaccttcaaccccggcgccgaacagatgcttggctacagcagtgccgacgtcgttggccatatgacgctggaaaacctgcacctgtcgcgcgagttgacggcgcgcgctgccgagttgagcgcgcgctacggtaaaagcattccgacctgccacgcgatgctggtcgagggcggcgaagtcggcggtcacgaggcgcgcgagtggacgctggtgcgcagcgatggcagccatctgccggtgaacatgctggccacaccggtgctcgatgagcaaggtttgtgggttggccatctggcgatctgcatcgacatcaccgagcgcaaacgcgtgcacgaagtgctggcggcgcgggatgtgttgctgaagaagctcagtgcgcacgttcccggtggtatctatcagttcaaaatggagttcgacgggcggttcagcgtgatctatgccagcgacggcattcgcgaaatctacgaactggagccggacgtgctgttgttcaacgctgaagcgatcttcacgcgcatccatcctcaggacatcacccgcgtgcgctcttccattcgcgcctcggcagacagcctcagcccgtggcgcgaggaataccgcgtgcaactgcccgaacgtggcctgcgctgggtgcgcggcgaggcgacgccggaggagctgccgggtggcggggtgctttggcatggctatatctcggacatttccgatctgaaacgcgtggaagaagaactgcgtgcgctgtcggtcaccgactccctgaccgggatccacaaccgtcgctacttccaggaacgcctgaccaccgaaatggcccgggtcgagcgcggcggtggcgagctgtcggtgatcatgctcgacatcgaccacttcaaacgcatcaacgaccagtacggccacgccgtcggcgaccgggtgttgcaagcggtgtgcgagcgcatcggtcatcgcctgcgccgcaccgatgtgttctgccgtttgggcggcgaagagttcatggtgctgtgcccggacatcgacggcgagcacgcgcacatgctcgcggtcgagttgtggcaaggcttgcgcggcgcgccggtggacgtggttggtgtggtcacggcgagtttcggtatcgccagttggcgaccgggggagggcgcagatgcgttgctgttgcgcgcggattcgggtgtgtatatggcaaagcagcgcggccgcgatcgcgtcgagcagatgagctaagcccggcgctgaacccttgtaggagtgagcctgctcgcgattgcggtatatcagtcaccatgatgtatctggactgacgctatcgcgagcaggctcactcctgcagaagatcagaagatcgcagcctgcggcagctcctacaggattatgtggcacctgcaggagctgccgaaggctgctcttttgcttttaaaggaccgaagccgtctgcggcaatcgcggttgcttgtagaggtccagcagcacctgatcgagcaccgacgatgccccaaacggtgccttgtcgttcagaatcgctaccaccgcccaggtattgccattcacatcacggctgaagccggcaatcgcccgcacagtgttgagcgtgccggtcttcacgtgagcttcgccgcgcatggcagtcgtcttcagacgtttgcgcatggtcccgtcagtgccggcgatcggcagcgagctgatgtattcggcggcgtaagggctgtgccacgcggcttgcagcatgttcgccatttcacgggcgctgacgcgttcggcgcgggacagaccggagccgttctccatcaccagatgcggtgcggtgatgcctttcttcgccagccactgacgaaccacgcgttgcccggccttggcgtcgtcaccgtcggcgtcgttgcggaatcgctggccaaggctgaggaacagctgctgggccatggtgttgttactgtacttgttgatgtcgcggatgatttccgccagatccggcgagtaggcacgcgcgagcagtttggcgttgcccggggtcgaggccagacgatccttgccctgaatgctgccacccagttctttccagatcgcgcgcacggcgccggcggtgtaggtcgcatggtcaagcagagacaggtaggtctgcgagctgcagccttcgcccaactggccggcaacggtgacggtaacgctgccatccgcctgcggcaccgggttgtagcgcacgccgccggtgcattgcttggagttcagtgctttgacggtgttttcaatacgtacagtggcgatcggcggctcgaccgaaatcagcacccggccgttatcgttgcgggcgacaaagcgcagggcctttaggttgaccagcagcgaatcgggtttgaccaggaacggtttgttctcgtcgttgccgtcatcgttgaattccggcaacaccggctgcacgaaaaaattgcgatcgaggatcaggtccccggtgacctgggtcacgccgttggcgcgcaggtcgcgcatcagcagccagagtttttccatgttcagcttcggatcgccgccacctttgaggtagaggttgccgttgaggatgccgccgttcaggtcaccatcggtgtagaactcggttttccactgatggttggggccgagcatttccagcgccgcgtaggtggtgaccagtttcatggtcgaggccgggttgaccgacacgtcggcgttgaacacggttggcgtgcccggaccgtccagtggcaccatcaccagcgacagggcgctaggctgcaatttgctcgccttgagggctttttcgacgttcggggtgagggaggtgttgatggtggcagcagaaacaggcagggccagaggcagaaggaggccggcgagaaacagtggacgcaacgatttgatcatatgaaataaaaccctacagccgagggggaaaaagacgaggacatggatgaaaaagccctcagtggtcacgaaagtgtcggcattatgccccaaggtgtaaccgattgtgccgtcctcggggtggcgattcgttgatttttttacaggcggtcgcccgctgtgtccagagagtcgggcaatcgattgcttaaactggtaaagtgcccgccgtatttacttaagaggattgttccaatggcgactaaccgttcccagcgtctgcgcaaaaaactgtgcgttgatgaatttcaagagctgggtttcgaactgaacctggacttcaaagaagacttgtccgaagaagccattgacgctttcctcgaagcattcatcaaagaagccatggaagccaacggtctgggttatgttggcggcgacgacttcggtctggtttgcctgcagaagcgtggctcggtcaacgaagagcagcgtgctgccgttgaagcctggctgaaaacccgcgccgagctgaccaagtatgaagtcagcccgttgctggacgtttggtatccggaaaagccgatcaacgcggctaagtgatactgaaaaaaacggcgacctgagggtcgccgttttttttcgtctggtgtttgggtgttcggtttgggatttgtggtgaggctacccctcaccccagccctctccccgaggagagggagccgatatgcgagctgttcaatacctgagttcgactcggtatcccacgtcggcgtatttcttccaagcacctcggtcagtcccctctcccccggggagagggttagggtgaggggcttttgaccttaagccttacgccaattcaaaatcaccagcgtcaaaacccccgcgacaatcccccaaaacgccgaaccaatggaaaacagcgtcaaccctgatgccgtgaccataaaggtaatcagcgccgcctcacgttccttcacctcggtcatggcaatgctcaaaccattgatgatcgaaccgaacaacgccaacgccgcaatcgacagcaccagctccttcggcagcgccgcaaacaacgccgccaatgtcgcaccgaacaccccggcaatcccgtagaaaatcccgcaccaaaccgccgcggtgtagcgcttgttgcgatcttcatgggcgtgcggcccggtgcagatcgccgcgctgatggcggcgaggttgatgccgtgggaaccgaacggcgccagtaacagcgaggcgatgccggtggtggtgatcagcggcgaggccgggacgttgtagccgtcggcgcgcaggacggcgatgccgggcatgttctgcgaggtcatcgccacgacgaacagcggaatgccgatgctgatggtcgcggccagtgagaagtgcggcgtggtccacaccggcgtcgccacttccagatgaaagccgctgaagtccagcaaacccatgaagcccgacagcgcggtgccgatcagcaacgcggcgagcaccgcatagcggggcgacaggcgcttgaccactaaataagtgaagaacatccccagcaccagcccggtgcggtgctgcgcggcgacgaagatttcgctgccgatcttgaacagaatgcccgccaacagtgccgccgccagtgaagccggaatctttttcaccagtcgttcgaagctgccggtcagcccgcagatcgtcaccagtacggcacaggtgatgtaggcaccgatggcttcgccgtaactgacgccgcccagactggtgatcagcaacgccgcgccgggtgtcgaccaggcgatggtgatcggcgtccggtagcgcagtgacaggccgatcgaacatacggccatgccaattgaaatcgcccagatccacgaagaaatctgcccgctggtcaggcccgccgcttgcccggcctggaacatcagcaccaaggagctggtgtagccggtcatcatcgcgatgaaaccggcgacgatggctgaaggcgaagtgtcggccaaggggcgcagttgagtgtgggtggcgtcgttcatgacaacggtgttccttataccaatgaagatgtccgccctgacgcaaacccttgtaggagctgccgaaggctgcgatctgttgatcttgcttcttaaaatcaaagtcaaaagatcgcagccttcggcagctcctgcaggggaggcggtgttctggcagcggattctgtgatcaagcctaaactcattcgtaacggatcgttgcaatacagccaaagtcacaaattgccgtacagtcgtgttgccacctttcattgtgtacaatcgcgctgttttttacgcgatacttgccagcgacctactgtgccgtattacagtcacggtctattcgccgcagttctcccgactcgagtgcccatgaacgaacagttgcaacccctcaagaaacaaccgcgagcaggcaaagccggccgcagcggaacccaggacgatattgtctacgcgcatatcttcgaggccatcctcgaacagcgtctggcgcccggcacaaaattgagcgaagaagcgctgggggaaatcttcggggtcagccgcaccatcattcgccgcgcgctgtcgcgtctggcccatgaaggcgtggtgctgttgcggcccaaccgtggcgctgtcgtcgccagcccgagcgttgaagaagcgcgtcaggtgttcatggcccgtcgtctggtcgagcgcgcgatcactgaactggccgtgctgcacgccaccgccgagcagatcgctgaactgcgccagatggtcaacgatgaacgcgacagtttctctcgcggcgatcgtggcgccggcattcgtctgtcgggcgaattccacctgaaactggccgaagcggcgaaaaacgcgccgctggtgagtttccagcgcagcctggtttcgcagacctcgctgatcattgcccaatacgaaagcggcaaccgctcgcactgttcgtatgacgaacacacgcagttgatcgacgcgatcgagaagcgcgacggcgagttggcggtgaatctgatgatgcatcacatggatcacatcgacagcaagctcaacctcgacgaggaaggcgcgtcggatgatctgcatgcggtgttctcgcatttgttgcagaccaagaagcctgggcgtccgagcgccaagctctaaagaagaccgagctgctccaatcgctggcaagccagctcccacagggttttgtggggttcacccgatttgcgttacagcacaaatcctgtgggagctggcttgccagcgatagcaatctgacaggcaataaaaatcccccggggtgaacacctccgggggattttttgtgcctggttgatcgttcccatgctccgcgtgggaatgcctcttgggacgctccgcgtccagtgacgcggagcgtcacaggctgcattcccacgcagagcgtgggaacgatcatttttttggacgatagctctagcgctgatgcaccagcgcacccgccgcataggtctgctgcaccgtgcgatcatcgcccagcgtcatcaacacaaacaacgtttcggcaatattgttggcctgcttcaggcgatagctgagcaacggcgtggcgttgtaatccagcaccaggaagtcggcgtcggaacccggttgcaggttgccgatcttgtcttccagacgcagcgcccgcgcaccacccaaggtcgccagatacagcgacttgaacgggctcaggcgcgcaccttgcagttgcatcactttgtacgcttcgttcagcgtctgcagcagcgagaaactggtgccgccgccaacgtcagtacccaaaccgacattgagtttgtgcttctcggccatcggcaagttgaacaagccgctgccgaggaagaagttcgaggtcgggcagaacgagatcgccgaaccggtttccgccagtcgtgcgcattcgtcgtcgcacaggtgcacaccgtgggcgaacaccgagcgctcgccgagcagattgtagtggtcgtaaacgtcgaggtagcccttgcgctccgggaacagctccttgacccactcgatttccttgaggttctcgctgatgtgggtctgcatgtacagatccgggtattcggtcagcagttggccggcgagggtcagttgctccggggtgctggtcggcgcgaagcgcggggtgactgcatagtgcaaacgacccttgccatgccagcgctcgatcagcgccttgctctcgacgtagctggattcagcggtatcggtcagataatccggtgcgttgcgatccatcatcaccttgcctgcgatcatgcgcaggtcgagctgctcggctttttcaaagaacgagttcaccgactgcgggtgcacgctgccaaacaccagcgcggtggtggtgccgttgcgtagcagctccttgacgaaaatgtcagcgacttcgtcggcgtgagccttgtcgccgaactggctttcgcacgggaaggtgtaggtgttcagccagtcgagcagttgctcgccgtaggcaccgaccatgccggtttgcggaaagtgaatgtgcgtgtcgatgaagcccggggtgatcaacgcgtcttggtaatgctcgatttcgatgtccgccggcagggtcggcagcaggtcgctggcgtggccgagggcgctgatcttgccgccatcgaccaccagcaggccatcctcgaaatattcgtaggaggcttcgatcccgacttcggcggggtcggcgatgctgtgcaggatggcggcgcggtaggctttgcgagtcagaggcatgagggttctctaatcagtttgaggctttgagtttggcggcctgactgcgccgcgaaaccggcagcagtttggcaatcggttcggcgctggcagtctgctggccgaagttggcgttgtaggtggcgatgatttcgccggcgatggagatggcgatttccacaggcagtttgcctttgacttcgccgatgcccatcgggcagcgcatgcgttgcacgacgctgctgtcgaaaccgcgatcacgcaaacggtgttcgaacttcacgcgtttggtcttcgaaccgatcaggccgaagtaggcgaagtcgttgcgcttgaggatcgcagcagtgagttcaaggtcgagctgatggttgtgggtcatgacgatgcagtaactgccgacgggcaggtcatcgatttcatccacaggctcttcggcgacgattttacgcacgccgtgggggatctgttcggggaattcggcatcgcgcgaatcgatccagcgcacccggcagggcaggctggcgagcaatggcacgagggcgcggccaacgtggccggcaccgaatacagcgatctgcgcctgcacctggcccatcggttcgaacagcaacacggtggcgccgccgcagcactggccgaggctggcgccgagactgaagcgctccaagtgggtgtcctgcttgccgctggcgagcatctcgcgggcgatctgcatggctttgtattccagatgcccgccaccgatggtgtcgaagctctggttagcgctgatgaccattttcgagccggcgttgcgtggcgtcgagccgagttcttcgatgatcgtcaccagcacacagggttcgccctggttctgcaggtcggcgagggcgtcgatccagttgtacatacacacctctcagatcgttcccacgctctgcgtgggaatgcatcactggacgctccgcgtccgctgttcaggatgcgacgcagagcgtcgcgggctgcattcccacgcagagcgtgggaacgatcatcagagcggagccaactcggtttcagcttcaacggctttcaccgccttcaactgccgcatctgctcgcaaccccacaacacccgctccggcgtcgccggcgcatcaatctgcggctggtgcttgtaatcaccgaggctcgccaccgcatccttgatcgcacaccacgaggcaatcccgagcatgaacggcggctcaccgacagccttggaatggaacaccgtgtcttcggggttcttgcggttttccaccagtttcacccgcaggtcgagcggcatgtccgccacggccgggatcttgtagctggccgggccgttggtcatcagcttgccttttttgttccagaccagctcttccatggtcagccagcccatgccctggatgaaaccaccttcgacctgaccgatgtcgatggacgggttcagcgaggcgccgacgtcgtgcaggatgtcggtccgcagcattttgtactcaccggtcagggtgtcgacgatcacttcgcagcacgccgcgccgaaggcgaagtagtagaacggacggccacgcgcctggctgcggtcgtagtagattttcggcgtcttgtagaagccggtactcgacagcgacacctgattgaaatacgcctgctggatcagcgcttcaaaggtcaggatgtggtcgcgaacccgcacgtggccgttgtggaattcaacgtcttcttcagtgactttgtagtgccgcgcagcgaattcgatcagacgtttcttgatgatttccgccgcgttctgcgccgctttaccgttcaggtcagcgccgctggacgccgctgtcggcgaggtgtttggcaccttgtcggtgttggtcgcggtgatctgcacgcggtcgatttcgacctggaacacttcggccacgacctgcgcgactttggtgttcaggccctggcccatttccgtgccgccgtggttcaggtggatgctgccgtcggtgtagatgtggatcagcgcaccggcctggttcaagaaactcgcggtgaaggaaataccgaatttcaccggggtcagcgccaggccttttttcaggatagggctgttggcgttgtagcgacggatcgcttcgcgacgctcgtggtactggctgctttcttccagttcggcggtcatttcctcgagcatgttgtgctcgacggtctggtagtaatgggtgacgttgcgctcggtcttgccgtagtagttggccttgcgcacagccagcggatcgaggtgcaggtgacgggctatcgcgtccatcacttcttcgatagcgaccatgccttgcgggccaccgaaaccacggtaagcggtgttcgacgcggtgttggtcttgcagcggtgaccgttgatggtcgcatcgcccaggtaatacgagttgtccgagtggaacatcgcgcggtcaacgatggaggcggacaagtccggcgagcagccgcagttgccggccaggtccatgttgatcccgtgcaggcgcccggtgctgtcgaagccgacgtcgtactccacgtagaacgggtgacgcttgccggtcatcagcatgtcttcgacgcgcggcaggcgcatcttcgtcggctggccggtgaggtgcgccaccaccgcgcacaggcacgccgggctggcggcctgagtttccttgccgccgaaaccaccgcccatgcggcgcatgtcgacgacgattttgttcatcgacacgtcgagcacttcggcgaccagtttctgcacttcggtcgggttctgcgtcgagcagtaaacgatcatgccgccgtcttcggtcggcattaccgaagagatctgggtctccagatagaagtgttcctgaccgccaatgtgcagcgtgccttgaatgcggtgttcagcggtcgccagcgcagaggccgagtcgccgcgctggtgggtgtggctgtcgagcacgaagtggcgtttgcgcagggcttcgaccacgtcgagcacaggttcgaggtcttcgtattcaatgatcgcggccatcgcggctttgcgcgcggtttccagatctttcgcagcgacggcgagcaccggttgaccgacgaactgcacgtcatcgatggccagcagcgggtcgccgggcatcagcgggccgatgtctttcaggcccggcacgtcttcgtgggtgatggcgatgcgcacgccttcgaaggcgtagcacggcgaggtgtcgatgctgatgattttcgcgtgggcgcggtccgacatgcgtgcatacaggtgcaactgattcggaaactccaggcgatcatcgatgtactgcgcttcaccggacacgtgcttggcggcgctgtcgtgcttgacgctgcggccgacacccgaggtcaggtccttggcgaacagttcagccagttcggcctgggttttttctacgccgtgatggttagacataagcggtcacccgagtctcgatgtgcggtgtttgcagttcgatgaagtatttgcgcagcaggttctgcgcgctgagcaggcggtattccttgctggcgcggaagtccgagagcggggtgaaatcttccgccagtgcggcgcaggcacgttcgaccacggcattgttcaatggcgcgccgatcagcgcggcttcacagtgggcagcgcgcttcgggatcgcggccataccgccgaaggccatgcgtgcatcggtgatcacaccgttttccacgcgcaggttgaacgcggcgcagacggcggagatgtcatcgtccagacgcttggagactttgtaggcgcggaacaactgttcagccgtggcgcgcggcacgatgatcttctcgatgaactcactttcctgacgggccgtgaccttgtagtcgatgaagtaatcgtcgaggttcaaggtgcggcgggtttcgcctttgcacagcaccacttgcgcgccgagggcgatcagcagcggtggcgagtcaccgatcggcgaggcgttgccgatgttgccgccgagggtgccctggttgcggatttgcagcgaggcgaaacggtgcagcaattcgccgaagtccgggtactcggcgttcaacgcttcgtagcagtcggagagggcggtggcagcgccaatttcgatgcggtcatcgaaggtttcgatgcgcttcatttccgcgacgttgccgacgtagatcatcaccggcagggtgcggtggaactgggtgacttccagcgccagatcggtaccgccagcgagcaggcgtgcttgtggataagcgtcgtagaggtcggccagatcagcaacggtcagcggcaccaggcagcgtttgtcgccgctgttcagctcgccgatatcggtcggggcaatggctttgaggcgcgcgatggtgtccgcttcgcgggcatcgaactgatccggttgcttgccgcagcaggattgctcggcagcggccagaatagggcggtagccggtgcagcggcagaggttgccggccagcgcttcgtgggccttggcctgatccggtgcatcactgttcttttgcagggcgaacagcgacatgacgaagccgggggtgcagaaaccgcactgcgagccgtggcactcgaccatggctttctgcacgctgtgcaattcgccctggtgtttgaggtcttcgacgctgatcagttgtttgccgtgcagcgacgagacaaaggtcaggcacgagttgaggctgcgatagcgaatgtgttcgcggccatcgtcatccgtttgcaactcgccgaccaccacggtgcaggcgccgcagtcaccgctggcgcaaccttctttggtgcccgatttaccaacgtgttcacgcaggtaattgagcacagtcagattcgggtccagggcgtgctcgctacggagttcctggttaagtaaaaactggatcacggaaggcctcgcagactcattattgttgttaaccgacttgagccgaatttagcaggtctgacttttcggtcaatggttttctgacttaaaggtcaggaaagtgcatttcgtcgatcaacaatgtgtctattcagtattgaccctcattggtcaccccgcttttttgcgggaatcgtgccaaaaaccgctgagtgggcactccgccatgagcccgcatttgcgctacactgcgccgcttgtgcagatcgatagagtttgaaggacaaccatgacgttcaaggcgccggacagcctcgccgagcaaatcgctcaccacctcgccgaacgcatcattcgtggcgaaatgaagccgggagagcgcatccaggaacagaaggtcacgctggcactgaatgtcagccgcggctcggtccgcgaagccttgctgatcctcgaacgccgtcacctgatcgcgatcctgccgcgccgtggcgctcacgtcaccgaactgacgccgcacaaggtgcagagcctgtgcacgctgatgagcgagctgtacatcctgctcggcaactcggtggccaatggctggcaagtgcagtcggacatggcgccgttcgtgcagatccagcagcgcctgaccgccagctacgagcgtcaggacatccgcagctttgtcgacgacagcttcagcgtgatgcgcgccgcctatcctttcgccaacaacccgtacctgcaagaaacggtcgagaacctgcagccggcgatgagccgcgcgtacttcctcgccctcgaacagcgcaaggcttcaatgagcgagttcctcgaactgttcgaacgcctgctcgccgctgtgctcgcccgtgatttaccgcagatccgcatagtgctgacggcgtacgcccagcgcagttgcgatctggtggtctccgcgctgacggtcgcctaagcgtgcggctcaagtgcatcaaactggcgggattcaaatcctttgtcgacccgaccacggtgaacttccccagtaacatggcggcggtcgtcgggccgaacggttgcggcaagtcgaacatcatcgacgccgtccgctgggtgatgggcgaaagctcagcgaaaaacctgcgtggcgagtcgatgaccgacgtcatcttcaacggctcgaccagccgcaaaccggtgagtcaggccagcatcgagctggtcttcgacaactccgacggcacgctgctgggcgaatacgcggcctacgccgagatctcgattcgccgcaaagtcacccgcgacagccagactacgtattacctcaacggcaccaaatgccggcgtcgcgacatcaccgacatcttcctcggcaccggtctcggtccgcgcagctattcgatcatcgagcaggggatgatctccaagctgatcgaatccaagccggaagacctgcgcaacttcatcgaagaagccgccggcatctcgaaatataaagagcgccgccgcgagaccgaaaaccgcatccgccgcacccacgaaaacctcgcgcgtctgactgacttgcgcgaagagctggagcggcaactcgaacgcctgcaccgccaggccgaagcagcgaagaagtatcaggaattcaaagccgaagagcgtcagctcaaggcgcaactgtcggcgttgcgctggcaggatctgaatgatcaggtcggccagcgcgagtcgatcatcggcactcaggaaatcagtttcgaagccttggttgccgagcagcgtaatgccgatgcggcgattgagcgcctgcgcgacggtcaccatgacctgtccgagcgcttcaatctggtgcaggggcgcttctattcggtcggtggtgatatcgcccgggtcgagcagagcatccagcatggccagcaacgtctgcgtcagttgcaggacgatctgaaagaagccgagcgcgcgcgtctggaaactgaatcccatctgggccacgaccgcaccttgctgctgaccctcggcgaagagctggatatgctcacccccgagcaggaagtcaccagcgccgccgccgaagaagccgccgctgcgctggaagattccgaatcggtcatgcatggctggcaggagcagtgggacgccttcaacctgaccgccgccgaaccgcgtcgtcaggccgaagtccagcagtcgcgcatccagcagctggaaaccagcatggagcgtctggctgaccggcaaaagcgtctcggcgaagagcgcgcgttgctctcggctgatccggaagacgcggcgatcatgcagctcaacgagcagctcgccgagtccgaagcgaccctcgaagatttgcagaccagtgaagaagcgcaggtcgaaaagcttgaacaactgcggcaagaattgcagcaagcactgacttcgcagcaacaggcgcagggcgatttgcagcgcctcaatggtcgcctcgcatccctcgaagccttgcagcaagccgcgctcgacccgggcaccggcaccgccgaatggctgaaggagcacaatctcgccgagcgtccgcgcctggccgaaggcttgaaggtcgaggccggttgggaactggcggtggaaaccgtgctcggcgctgacctgcaagcggtgctggtcgacgatttcagcggtttcgatttgtccggtttcacccaaggtgatttgcgcctgctcagcccggccagcgatggcgtgcgcgtcgcgggtagcttgctggacaaggttgatgcgcagatcgatctgtcgccgtggctcggtcaggtcaaaccggtcgacagccttgagcaggcgttggctttgcgtgggcagttgagcgccggcgaaagtctgatcagccgcgacggttactgggtcggccggcactttttacgtgtgcgccgggccagcgaagcggaaagcggcatgctcgcccggggccaggaaatcgaagcgctgcacctcgaacgcgaagagaaagaagccacggtcgaggccatggaaacccgtctgcagaccctgcgcgcgcaacagcgtcagcaggaaaacggccgcgagcatttgcgtcgtttgctgcaagacgaagcgcgtcagcagggcgagttgaaagcgcaactgtccgccggtaaagccaaggccgagcagctgacattgcgccgtacccgtctcgatgaagagctggtcgagctcggcgaacaacgcgagcttgagcacgaacaggtcggcgaagcgcgcatgcaattgcaggaagcgctggatgccatggcgctcgacaccgagcagcgcgagttgctgctggcccagcgtgacagcctgcgtgagcgcctcgatcgcgtacgtcaggaagcgcgccagcacaaggatcacgcgcatcaattggccgtgcgtcttggctcgttgcgcgcgcaacatgactccacgcgtcaggccctcgaacgtctggaaatgcaggccgaacgcctgaccgaaaagcgcgaacagttgagtctgaacctggaggagggcgaggcaccgctggaagagctgcgcctgaaactcgaagagctgctcgacaaacgcatgaccgtcgacgaagaactcaagactgcgcagatcgctctcgaagatgccgaccgcgaattgcgcgatgcagaaaaacgccggacccaggccgagcagcaatcacaattgattcgcggccagctcgaacagcagcgcatggaatggcaagccctgaccgtgcgccgcaaggccttgcaggatcaattgctcgaagacggctacgatctcaacggcgtgctcgcgacattaaccgcgcaggccagtgaacgcgaagccgaagaagaactcgaacgcatcaatgcgcggattcagcgcttgggcgcgatcaacctcgcggccatcgacgaatacacgcaacaatccgagcgtaaacgttatctggatgctcaggacgccgatctggtcgaagcgctggagacgctcgagaacgtcatccgcaagatcgacaaggaaacccgtaatcgcttcaaagatacctttgatcagatcaacggtggtttacaggcactttttccaaaagttttcggtggtggacgggcgtatttggaactgacgggcgaagatctactcgatacaggggtaacgatcatggcgcagccgccagggaagaagaacagcaccatccatttgctctccggcggggaaaaagccctgaccgcgctggcactggtttttgccatcttcaagttgaacccggcgccgttctgcatgctcgatgaggttgacgcgccactggatgacgctaacgttggacgctacgcacgcttggtcaaagagatgtcgcagaccgtgcagttcatctatatcacccacaacaagatcgccatggaaatggccgagcagttgatgggcgtgacgatgcatgaaccgggttgttcgcgactggtagccgtggatgtcgaggaggcgatggcgatggtggacgcctgagccagcgtggtgtcggaaaggtaattgagggctgtaggacttttttaccgggttcgacttgctggccaatcgacatattcgtgcaagccaatgagacagacggtgtaaagttgtctttggtcgtgctagtttaatgtcaatttttcgtatacgtgggcaaaacgcctgtcagaacatagagttggcgccacgttttaaagcggtttgcacaatgtaaaccccttatttttcagcattttttatagaggcacgggattacatggaaatcggtctgcgcgagtggctgatcgtcatcggcattattgtgatagccggtattcttttcgatggctggcgccgtatgcgcggcggcaagggaaaactgaaattccgtcttgaccgaagtctgtccaacctgccggacgaggacaccagcgctgagctgttgggcccggcccgcgttctggatacgcataaagagccgcaactggacgaacacgatttgccgtcggtgagcatgccggcccgcgaagcacgcgagcctcgcgaaaccgcctcgaaacgtggcaagcgcggcggcaagggttcggcgcagggcgacttgaatctggatctggatctggacgacggcccgagcttcagcagccgtgacgacgatttcgttgaagacaccaagccttcgccggcggtggtcgacaaagaccagccgcaagctgaagaagtgctggtgatcagcgtgatctgccgcgacgctgccggcttcaaaggcccggcactgttgcagaacatcctggaaagcggtctgcgttttggcgagatggatattttccaccgtcacgaaagcatggctggcaacggtgaagtactgttctccatggccaatgcggtcaagccgggcatcttcgatctggacgatatcgaccatttcagcaccccggcggtgagcttcttcctcggcttgccaggtccgcgtcatccgaagcaggccttcgacgtgatggtggcggcagcccgcaagctgtcgcaggagctgaacggtgaattgaaagatgaccagcgcagtgttctgaccgcgcagaccatcgagcactaccgtcagcgcatcgtcgaattcgaacgtcgcgccttgacccagaagcgctaaggccagatcaaaagatcgcagcctgcggcagctcctacaaaggatcgcgatcctgtaggagctgacgagtgcaacgaggctgcgatcttttaaggatgaaactggagcagcctcggctgctcttttgctttatgagagaacacccatgaccgccgccaaaaaccgcattctcgagctgcgcgctgaactcgatcagcacaactaccgttatcacgttctcgacgagccgagcattccggacgccgagtacgaccggttgttccacgagctcaaggcgctggaagcggccaacccggaactgatcagcagcgactcgccgacccagcgtgtcggcagcgtggcactcaccgcgttcacccaggtgcgccacgaagtgccgatgctcagcctcggcaacgccttcgaagaaagcgacatgcgcgagttcgatcgccgcgtcaccgaaggtctggatatccccgcgggcgatctgttcggcggtggcgcggcagtggaatacagctgcgaaccgaaacttgatggcctggcggtcagcctgctgtatcaggatggcgtattggtacgcggcgccacgcgcggcgacggcaccacgggcgaagacatcagcgtcaacgtgcgcaccgtgcgcaatattccgctgaagctgcacggcgaaggctggccggtgacgctggaagtgcgcggtgaagtgttcatgtccaaggccggtttcgagcgtctcaacgcctcgcaactggaagtcggcggcaagactttcgccaacccgcgcaacgccgcggccggcagcttgcgtcagctcgattcgaagatcaccgccaaccgtccgctggaattctgctgctacggcatcggtcaggtttcccacgatattgccgacacccacattggcaacctcaagcagttgcagcagtggggcatgccgatcagccacgaattgaaattggccaaaggcatcgacgagtgcctggattactaccgcgatatcggcgcgcgacgtaatgatctggcctatgaaatcgacggtgtggtgttcaaggtcaacagcattgccgatcagcgcgaactgggcttccgcgcccgtgagccacgttgggcaatcgcgcacaaattcccggcgatggaagagctcaccgagttgctcgacgtggaattccaggtcggccgcacgggtgctgtcacgccagtcgcacgactgaagccggtcaaggttgccggtgtcactgtggccaacgccacgttgcacaacatggatgaagtcgcgcgcctgggcctgatgatcggcgacaccgtgatcatccgccgcgccggtgatgtgattccgcaagtcgtacaagtggtcatggatcggcgtccggaaaacgcgcgcgcggtgcagattcccgagagctgcccggtgtgtggttcccacgtcgagcgcacgcaactgatcaagcgcagcaagggcaaggaaaccgtcagtgaaggcgcggtgtatcgttgcgtcgggcgtctggcctgcggtgcgcagttgaagcaggcgatcatccacttcgtctcgcgtcgggcgatggacattgaaggccttggcgacaaaagtgtcgagcaattggtcgatgaaggtctggtcagttcgccggccgatctgtatgcgctgaaattcgacgacatcgtcgacctcgaaggttttgccgaggtatcgagcaacaagctgttggcggccatcgaggacagcaagaagcctggactggcacggttcatttatgcgctgggcattcctgatgtcggcgaagagaccgccaaggtgctggcacgctcgctgggttcactggagcgtgtgcagcaggcgctgccgcaagtgctgacttacctgccggacgttggtctggaggtggcgcatgagattcacagtttcttcgaagatgcgcataaccagcaggtgattaccgagttgctcggtcatggtttgcagattcaggatcagggcgagttgggcgccgagtttgccgccagcaccacgctgggtggtttcctcgacaagctgcacattccttcggtcggccctggtggcgcgcagaaactggcggacaagtttggttcgctggaagcggtgatgaacgccgattggctggatatgcgtcaggcgttgccggaaaaacaggccaattctgttcgcgagtttttcgccttgcctgagaaccggcaactggccgaagcatctgaaaagcaactgcttgatttcggcatgcattggcagagcgagaagaaagtcgtcgagggcttgccgctttccggggagacttgggtgctgacgggcaaggtcgagttaatgagccgtgatgtggccaaggatcaccttgaaagcctcggcgccaaggttgccggttcggtgtcggcgaagactcattgcgtggtcgcaggtcccggtgctggctccaaattgaccaaggccaatgagctgggcgtgaaagtgatggacgaagaaacctttatcgccttcctcaaaacccacggcatctccgcctgacctgatcgttcccacgctcccgcgtgggaatgccgcccccggacgctccgcgtccgttgtgacgcagagcgtcactggatgcattcccacgcagagcgttggaacgatcaacccgcaagaatgatctagtcttggcaagccccagggagagatcgccatgcaccgctttttcgagcagttgagttcccgcatcgtcgcgccgttcatgggcgaatcctcacgcaacagcaaagtctggccgtgccgctgcggtcagtcgctgttctttcgcaacagccagtgcctggcctgcaacgccttgctcggctatcaacctgaagaaagtcgcctgacctcactgcagtcgggaccgtacgagggcacctggacgctggacgccgatcccgaggccgggctgttccgccgttgcgccaacctcgacaccgctgccgcgtgcaactggctgctgccggccaacgatcacgacagcctgtgcgtcgcctgcagcctcaatcgcaccatccccgacctgtccgatccggacaatcccgaacgctggcgcaaagtcgaaatcgccaagcggcgactggtcgcgcaactgatcaccctcggcttgcaggtcatcccgaaaaccgtcgatgaagacaccggtctggccttcgatttcatcggtgtcgacctcgaaggcaatgcgccgatgaccggccacgccaacggcctgatcaccctcgacatcaaagaggctgacgatgcccaccgcgagcaggtgagggcacagatgcacgagccgtatcgcacgctgctcgggcactttcgtcacgaggtcggccactattactgggatcgcctgatcgccaacggcccctggctcggttcattccgagatctattcggcgacgagcgcgtcagttacgccgaggcgctggatcgccattatcaacaaggcgcgccactcgactggccgcaacaatacgtcagcgcctacgcaaccatgcacccttgggaagactgggcggaaacctgggcgcactaccagcacatgatggacgccgtggacaccgcactgggcttcggcatgagcgcgcgggaaatggatttcgactaccagccgtttccgaccagcacgctgtatgacccggagcatcccggcggcgcggcgtttctgtcgttcgtcaacgcgtggatcgaactggccggcatgctcaacgaattgtcgcgcagcatgggccagccggatttctacccgttcgtgctgccggcaccggcgattgccaagttgcactttattcatctggtgatccagcaggcgggcggccgggcggacgaggttctggccctgtaggagctgccgaaggctcgggccgcgatcggacgatctttatgtccttgagcccgttcatatttttaatctacaaccaacggttgtaacttcgcctcagataggtacaatggcgcggctcgccgacaggcaagcgtcgttatggtgaccccatcggtccccccgcaacgattacccgtgaacctggtcagagccggaaggcagcagccacagcgggaacattgtgtgccggggtgtggctggtggggttgccaccttaacgaacaatcgaacgcttcaaccagaactgcatgggtttcgcccactgcggtttttttgtgtctgcgatttgtcaggtcggcacaaattccttgtaggagtgagcctgctcgcgatggcggtgtgtcagtcagttcatttttgggagacaggacgccatcgcgagcaggctcactcctacaggggttatggggtgccttcagaggatccggtatagagccggataatctcatcaatctcccccgacattttcatccgcaacaacgtgcgcaatatccgttgcaccggcactttcggatcatttctcacatagcaaccgaccttctgctcctgcaacaccgctaccccttgcagttgttgctccggcatcaaccgctggttaaaccagtctagcgtccactgattactcaccgcatagcgataacgcccggccatcagcttctccagcacctgttcttggttgcgcgcatcttcgcgctgcagtcgatcagcatcaaacaacggttgcagggtcgggtaggtgtagccgagaacggtgccgatggattggcggggcaaatgcgcagggtcggcgctggcgggttgatccttgcggctgatcaacagatcgcgctggaagaacagcggaaggctccagatgtaatcccccgactgattcggcagccacgactgtgcggcatagcagcgcacatctatttcaccgtgttccatgacgctctgcacgcgggcgcggggcaggacgtgaaactcggccggtacgccgacctgcgtggccaggctgagcatcagatcatagagaatgccctgggtcgggcggccgcgttcgtattgcaccatgggcatggcccagctgtcgggcatggcgaagcgcaacggggtttccgctgccgtcacattcaggctgattcccagcaacgcccccacggcccaccgcataaacgctccggtaattcccgctcctgagccgataaaagcctctgctgatgcagcttagccatattagacgaggacaccggatgcaattttgcccttgctccgctagcattagccgcttctgcttccttcgctgcgacggttttcgatgagttatcaggttcttgcacgtaaatggcgtccgcgctcgttccgcgaaatggtcggccagacccatgtgctcaaggctctgatcaatgccttggacagccagcggctgcaccacgcgtacctgttcaccggtacgcgcggggtgggtaaaaccacgattgcgcggatcattgccaaatgcctgaactgtgagacaggtatcacttccagcccgtgcggcgagtgttcggtgtgtcgtgaaatcgatgaaggtcgtttcgtcgacctgatcgagatcgacgccgcgagccgcaccaaggtcgaagacacccgcgagctgctcgacaacgtgcagtacgcgccgagccgtgggcgcttcaaggtctatctgatcgacgaagtgcacatgctttccagccattccttcaatgcgctgctgaaaacccttgaagagccgccgccgtacgtcaagttcatcctcgcgaccactgatccgcagaaacttccggcaacgattttgtcgcgctgcctgcagttctcgctgaagaacatgacgccggagcgcgtggtcgagcatttgacccacgtcctcactgccgaaaacgtgccgttcgaagacgatgcactgtggctgctcggtcgcgccgctgacggttcgatgcgggatgccatgagcctgaccgatcaggcgatcgccttcggtgaaggcaaggtgctcgctaccgacgtacgggcgatgctcggcacgctggatcatggtcaggtctatgatgtcctgcattcgttgatcgaaggcgacgccaaggcgctgctcgaaggcgtgcgtcatctggccgaacaaggcccggactggaacggcgtgctctcggaaattctcaacgtgctgcaccgtgtggccatcgctcaggcgctgccggaaggtgtcgacaacggccatggcgaccgcgatcgcgtgttggcactggcgcaggccttgccggccgaagacgtgcagttctattaccagatgggcctgatcggtcgccgcgatttgccgctggcgccggatcctcgtggcggtttcgaaatggtcctgctgcggatgctggccttccggcccgctgatacggcggacgcgccgaggcaaccgctaaagccagtggggatcagccaggccacagttgattccgcaaactcagtggctgccgcgcctgaacctgcgccggtagtcgctgctgctgttgcgccggctccagctccggcacccgtggcggtaccagcgcctgcaccggctcccgagcccgcgccggttgctcctgttgccgcgccagaacctgagcccgcgcctgtcgttgccgaagccgtcgtcgacctgccgtggaatgacccggtagagcccgagacggagccagagcccgaacccgcgcagcaacctgccgtcgaaccggtgctggaaaccgccgccgagcaacccgagttgccgccgatgccgttgccgaccccggacagcgtcgttccgcaggccccagaatgggctgcagcaccgattcccgagccttcggtcgccgacgtcgatgccgctacaccaggcatggacctggacgacgagccgccgctcgacgaggactacatcgaaccggacatggattcggcttacagctacctcgacgaactggccagtgaacacgctgccgagccagccccggagcccgagccagaaccggctgcggcgccggccaccggcctggcattgcaatggttggagctgttcccgaaattgccgatctccggcatgaccggcagcatcgccgccaattgcacgttgatcggcgtcgatggcgaccattggctgatgcacctcgacccggcgcacagcgcactgttcaacgccacgcaacagcgtcgtctgaacgatgcgttgaaccagttccacggtcgcacgttgaccctgaccatcgagctgatcaagcccgagcaggaaaccccggctcaggccgcgtcccgtcgccgtgccaaccgtcagcgtgaggcggaggaatcgatccatggtgatccgttcatccagcagatggtgcagcagttcggtgccgtcgtgcgacacgatactattgaacctgtcgatgccttggtcgcccaaggctaataactgaaggtgcctggcctcgaaggccgggcgctgttttgatccaagtacttttgaggtgattcccatgatgaaaggtggcatggccggcctgatgaagcaggcgcagcagatgcaggaaaaaatggccaagatgcaggaagaactggccaacgctgaagtcaccggcaaggccggcggcgacatggtcaccgtggtgatgaccggtcgtcacgacgtcaaaagcgtgagcatcgacccaagcctggtcgaaggcatgagcgaagacgacaaagaaatgctggaagcggtcattgcctccgccgtcaacgacgctgtgcgcaagatcgaaaagaacagccaggacaaaatgggcaacatgaccgccggcatgaacctgccagccggtatgaaactgccattctgattcgccaatcggcggcagatgagctacacaaatgccaggccttgcgcctggcatttttgtttccgactgatcgttcccacgctctgcgtgggaatgcagcccgggacgctccgcgtcccaagtacagagccgaacgcggagcgtccgttgcggcattcccaagcggagcatgggaacgatcagccccggcacttgaataaacatcgaacgcgcaaaagcctcaacggtctgctccctatacccgctgaattcacacttcacaggagacgctgacatgtccgaccctctcacgctcaaccaacgtttcgtcctcgcctcgcgcccggtcggcgcaccgaccccggaaaactttcgtctcgaacgcgaggcgctgccggatcttgcggatggcgaggtgttgctgaaaaccctgtacctgtccctcgatccctacatgcgcggacgcatgagcgatgcaccgtcctacgccgccccggtacaaatcggcgaagtgatgaccggcggcgctgtcagtcgtgtcgaggattcgcgtcatccgaaattccataaaggtgatctggtggtgggcgccaccggctggcagagccacagcatcagcgacggccgcaacatcattccgatcccggccgggctgccgagcccatcgatggccctgggtgtgttgggcatgccaggcatgaccgcgtacatggggttgatggacatcggtcagcctaaagaaggcgaaacgctagtcgtagccgctgcatccggcgcggtgggttcggtggtcggccaggtggcgaaaatcaaaggcctgcgggcggtcggcgtggcgggcggagccgagaagtgcagatacgtggtcgaggaactgggtttcgatgcctgcatcgatcacaaggctgccgattttgccgagcaactggccaaagcctgccctgatggcatcgacatctattacgaaaacgtcggtggtcacgtattcgatgccgtagtgccgttgcttaacccaaaggcgcgcatcccgttgtgcgggctgattgccggttacaacgcctccgaggcgccgcaaggcccggatcgcctgccgatgctgcaacgcacattgttgaccaagcgcgtgcgcattcagggctttatcgtgttcgacgactacggtgatcgtcagccggaattcatcagccacatggtgccgtgggtgcgcgacggcaaggtgaaattccgcgaggacgtggtcgatggtctggagcaggcgcccgaggcgtttatcggtctgctggaggggcgcaactttggcaaactggtggtgcgggttgcgcaggactgagcatttgacgctggccagaggcgcgggtataaaccgcgtctcgttgttttgtcggactttttacccatgagcttcagccctttgattcgccaactgatcgacgccttgcgcactttgccgggcgtgggtcagaaaaccgcccagcgcatggcgttgcagatgctcgagcgtgaccgcagcggcggcttgcgtctggcccaggccctcagccaggccatggaaggggtcggccactgccgtcagtgccgcacgctgaccgaagacgatctgtgcccgcaatgcgccgatacccgccgcgacgacacgttgctgtgcgtggtggaagggccgatggatgtgtatgccgtcgagcagaccggcttccgtgggcgctactttgtgctcaaggggcatttgtcgccgctcgatggcctcgggcctgaggcgatcggcattccgcagttgatgacgcggattgaagaagcggggacgtttaccgaagtgattctcgcaaccaacccgaccgtggaaggtgaggcaacagcgcattacatcgcgcagttgctgaacaacaaaggcctgattgcctcgcggattgctcacggcgtgccgttgggcggtgagctggagctggtcgatggcggcacgctggcgcattcgtttgccgggcgcaaacccatttctctctgataaaaatcaaaagatcgcagccttcggcagctcctacagggaagcgcgtatttccaatgtaggagctgccgaaggctgcgatcttttgatcttctgcatcttgtaaaccaagcaagcgctcggttaagttcggcgaacccttccgtggagctcgcccatgcctgcctttcaggaatacttcgatcccagccaccaattggtccgcgacagtgtccgacgtttcgtcgagcgcgagatcctgccggacatcgatcagtgggaagaagccgcaagcttcccccgtgagctgtacctgaaggctggcgccgccggcatcctcggcatcggttaccccgaggcgctgggtggcagccatgaaggcgatctgttcgccaaggttgccgccagtgaggaactgatgcgctgtggctcaggcgggctggtagcagggcttggctcgctggatatcggtttgccgccgatcgtcaaatgggcccgtccccaagtgcgggatcgtgttgtgcctcaagtgcttggcggcgagaaaatcagcgccttggcagtcaccgaacccggtggtggctctgacgttgccaacctgcaaacccgcgccgtgcgcgacggcgatgtctaccgggtcagcggcagcaaaacctttatcaccagtggtgtgcgcgcggatttctacaccgtcgcggtgcgtaccggtgcgccgggtttcggcggtatcagcctgttgttgatcgagaagggcacgcccggtttcaccgtcggccgtcagcttaagaaaatgggctggtgggcgtcggacaccgctgaattgttcttcgacgattgccgtgtacctgtgggcaatctgatcggcgccgagaacatgggcttcgcctgtatcatgggcaactttcagagcgaacgactggcgctggcactgatggccaacatgacctcacagcttgcgctggaacagagcctgaaatgggcgcgcgagcgtgaagcgtttggcaaaccgatcggcaagtttcaggtgatcaaacatcggctcgccgagatggcgactgcactggaggtatcgcgggagttcacttaccggcaagcggcgaagatggcggcggggcagagtgtgatcaaggagatttccatggcgaagaactttgccacggacacttcggaccggatcaccaccgaggcggtgcagattctgggtgggttgggttatatgcgtgagagtctggtggaacggctgtatcgggataaccgcattctgtcgattggcggcgggacgcgggaggtgatgaacgagatcatcagtaagcagatggggctttgaatggttgctggggctactggcctcatcgcgagcaggctcactcctacagggggaacgcattccaaattgtaggagtgagcctgctcgcgatggcggcctgaagggcgctacttacttatcggtcaaggcaaactgcgtcaggcagaaggtaggaatgcccatgtcttccaaacgctgcgacccattcagctccggcaaatcaataatcgccgccgcctcatgcacccgcgcgcccatgcggcgaatcaggttggctgctgcgatcagcgtgccgcccgtggcgatcaagtcatcgaacatcaccaccgagtcgccttcgcacaggctgtcggcgtgcacttccagaaacgcttcaccgtactcggttgcgtaaccttcggccaacacgtccgctggcagtttgccttgcttgcggaacaacaccagcggcttgttcaactgataggccagcaccgaaccgatcaggaaaccacgggcatccatcgcgccgatgtgggtgaagtcggcttcgacatagcggtgggcgaagctgtccatcaccagacgcagggcggttggcgactggaacagcggggtgatgtcgcgaaagatcacgcccggtttcgggaagtcgatcactgggcggataagcgatttgatgtcgaaggagtcgaagaccatcgtcgaggtgtcctggcagggctgcaaacggcgcagtatacccgcggctgaaacgcttcgctcaaccgcagatcgacattaaccttcgagcgagccaccggccagcgcgcagagctggatcgggtcgaggatgtgaatctccttgccctcggcggcaatcaattggttctgctggaaacgggtgaacacccgggacacggtttccaccgcgagaccgaggtagttgccgatttcgttacgcgacattgccaggcggaactgattggccgagaagccgcgcgcgcggaagcgggcggacagattgaccaggaacgtggcgatgcgctcgtcggcggttttcttcgacagcagcaacatcatttgctggtcgtcgcggatttcgcggctcatcacacgcatcaactgacggcgcagttgcggcaattgcagggccagttcgtcgaggcgttcgaaggggatttcgcagaccgaggtggtttccagcgcctgggccgacaccgggtgtttctcggtgtccatgccggacaggccgaccagttcgctcggcaggtggaaaccggtcagttgttcttcgccgctgtcgctcaggctgaaggttttcagggcgccggagcgtactgcataaacggaatcgaacgtgtcgccctgacggaacaggaactcgccttttttcagcgggcggccgcgtttaacgatttcgtccagcgcatccatgtcttccagattcagagaaagtggcaggcagagaggggccaggctgcaatccttgcaatgggcctggttatgagcgcgcagtttgactggctcggacatttcttaaatccttgtgggaaaacacacataagctgtaagggtaacccacgagaggacattcaggccagtctacggcgactttgtcccacagccataaagccgcagggcaagccgccgataaacaggtatcagaacgcatacaaggaacgattcgatggccgccattggcacgctgggccccgctggcagcgacgttgcggcattgccggagacgtttaaagcgtcttcgggcagtgcacgcgacgcgggctcgaccgaggaagcaaccccgaccttggtcgaaggtgtcaaagtgtcgctgtctggagcgtccatcgaaaaatctgccggcgctggcggcgataatcgcgatatcgaagaaagcggtctgcctgagaacatccagcaattgttgaagatgatccgtaaatttcaaaaagagattgccgagaaaaaggcgctcatcgaagcggtgatggctgacaagcgtctttccaacgaagaaaagatcaccaagactgccaccctgcgcggcgccatcgccgcgctgaacaccgggttgatcacggccaatcttgccttgtcgaaagtggtcgggcagtcgggcctcacggcagatcagaacctgaaagtcggttcgctgctgatgaaaaactagatcacccgcgagaaccgctgtcggttctgctgttccaggtaggcgtcgaacaccatgcagaccgagcgcaccatcaggcgcccggccggcaacaccttgatcccttcgcgatcaagctcaatcagaccgtcgttggccatgccttgcagttgcggccacagcgcaccgaaatatccctgaaaatcgacattgaattgctgttcgatctcggcgaagtcgaggctgaaattgcagatcagttgctgaatcaccgcgcgccgcagccgatcgtcggcattgcataccaggcctcgactggttgccagttgcgcggcggcgagggtgtgctggtattcgttgaggtcgctgctgttctggcaatacaggtcgccgatctggctgatcgctgaaacgcccaggccgatcaggtcgcaatggccgtgagtggtgtaaccctggaagttgcgttgcagggtttcttcctcctgggcaatcgccagttcgtcgtcgggcagggcaaagtgatccatgccgatgtagcgatagccggcggcggtgagctgttcgatggtgcgctcgagcatttccagtttctgcgcgggcgcaggcaattcactggcattgatccgccgctggggcatgaagcgctccggcaggtgcgcgtagttgaacaccgagagccggtccggttgcaggctgatcacctcttcgacggtacgggcgaagttgtccggggtctgcttgggcaggccgtagatcaagtcgatgttgatcgagcgaaattgcagggtgcgcgcggcgtcgatcacggcgcgggtttcttccaggctttgcaggcgattgaccgcacgctgcaccgtcgggtcgaggtcttgcaggccgatgctgacccgattgaagccgagttcgcgcaacaagcccatggtggaccagtcggcttcgcgcgggtcgatttcgatgccgtaatcgccggaatcgtcatcgagcaaattgaaatgcttgcgcaggtgcgccatcaactggcgcagttcgtcgtggctgagaaaagtcggagtgccgccgccaaagtgcagttgctcgaccttttgcgtcgggtcgaggtgacaggcgatcagctggatttcctgttcgagccgttgcaggtacggcagggcgcggccgcgatccttggtgatgaccttgttgcaggcgcagtagtagcaaatgttcgcgcagaacggcacatgcacatacagcgacaacgggcgcagggccttgcggctgtcacgcagggcatggaacaggtcgaaggtgccgacctgactgtgaaattgcacggccgtcggataagaggtgtagcgcggccccgccaggtcgtagcggcggatcagttcagagtcccaacgaatggcgtcgagcatgcgggcattcccccggataggctggcagtgtgagcgagtctatcggggtgcggcgatggggctcttgatttgcatcaacggggaggaggtgtgttgatcaggcgggcctcttcgcgagcaagctcgctcccacattggatcggcggtgcaacacaaatcccctgtgggagcgagcttgctcgcgaaggccgcaccgccgatctaatgccccatcaaccaatgctgatgtgggccgggtaatgtccagatcccgaacaggatcaccagcaatccaccggccatgcgcacgctgcgtttgcgcaaaatggccgtgacgcgttctgccgcgaggcccgtggcgagcagcaccggccaggtgccgagcccaaacgcaagcatcaacaacgcactgtccagcgcgttgccctgactcgccgaccacaacaatgtgctgtaaaccagcccgcacggcagccagccccacaacgcgccaagcagcagcgcgcggggcagactcgacaccggcagcaaacggttggcgacgggttggatgtagcgccacaaaccgcgtccgagactttcaatgcgcgttagcccgctccaccagccggccagatacaaacccatggtgatcagcaacaacccggccagcacacgcatgaacaacgctgcaggactgttcgccaccgcccaacccgccagcccgatcagcaagcccgccgtggcataactgaggattcggcccaggttatacgccagcaacaagcggaaacgtcggctgcgttgctccttgggaatcgccagggtcaacgcgcccatcaaaccgccgcacatgcccaggcaatggccgccaccgagcaagccgaggatcagcgccgagatcagcagtggcaccagttcaagcatcgggcggggccttgtcgtctgctttgctggcgttggcttcgtccaccgcagcagtgtggttcggatcctgatcgtcgaacaggatgctgtgggccgggccgtcgagatcgtcgtactgcccgctgtccaccgcccagaagaagatgtacacggcgatggccacgatcagcagtgcggccgggatcatcacgtagagagctggcatctgtactccaggcccgcgcggctcaggccggcagcgggcgggtttctgagcggtggctgactggcgccgggctcggcaagcgagtcaggcgcaaggcattgagcaccacggtcaacgaactgatcgacatgccgacggcggcccacaccggagtgatccagccaagggcggcgaatggcaacatgaggccattgtacagcgccgcccacagcaggttctcgatgattacccgacgggttcgccgcgcgagggtgaaggcctggaccaaggcgtcgagacgattggacagcagcacggcatcggcactggttttcgccagatccgtggccgagcccatggccacgctgatatcagcggcagccaacaccggcacatcgttgacgccgtcgccgagcatcagcaccttgcggccttccttgtgcagttgttgcagcacttgcagcttgtcgtcgggacgcaaaccgccacgagcctcatcaatacccagttccgccgccacgctagcgaccatcggcgagctgtcgccggacaacagcaatgtgcgccagccacgcgccttgcacgcggcgagcagggcgggggcgtcgtcgcgcaagcggtcgtcgaggccgaaccacgccagcgggccttgagcgtcgccgagcagcaaccattggccggcctcgttcggcatggccggcacaacggcgccgctgagagcacagacaaactcggcctgaccgatgcgcaagcgctgctcgccgaccagcccttcgaggccaagtcccggcgtactctggacgtcttcagcggcgagcggcgcacggccgaaggcgcgggcaatcgggtgttccgagcggttttccaacgcggcagcgaggctcaggcattggtcgctgtcgtgcgcgccgagtgggcgaatcgaacgcagtaccagccggccttcggtgagggtgccggtcttgtcgaagatcaccgtgtcgatctgattcaagccttccagcacatgcccgcgcgtcagcagtaagccgagtttgtgcagggtgccggtggcggcggtgagggcagtcggcgttgccagcgacagtgcgcacgggcaggtcgcgacgagcatggcgaggacgatccagaacgcgcgcgaagaatccagttcccaccacagcaggccgatggcggcagcggcgatcagcgacagcagcaggaaccattgcgcggcgcggtcggcaatttccgccagccgcggtttttccgcctgggcgcggtcgagcaggcggacgatggccgacagtcgtgtgtcctggcccagcgcctgcacttccacggtcagcgcgccttcgacattcagcgtgccggcggtcacagcatcaccgggcatgcgcggttgcggcaggtattcgccggtcagcagtgattcgtcgatgctcgattggccatcgatgatcttgccgtctgccggcagaatcgaaccgggcgggatgaggatttgatcactcaggcgcaattcgctgagcagaatgcgttcgctctggccgtggttgtccaggcgcagacacgaagcgggcaacagattgaccagttgggccgtggcagccgctgtgcgttcccgtgcgcggcgttccaggtaacgtccggcgagcaggaacagcgcgaacatgcccactgcgtcgaagtacaactcgccgacaccggtgatcgaggtccagatcccggcgatgtaggcgctgccgatcgccagcgacaccgagacatccatggtcaggtgtcgtgtgcgcaaatcgcgcatcgcgcctttgaagaacggcgcgcagctgtagaacacgatcggcgtggtcaggaacagcgccacccagcgcaggatcgtgtgtagctcggggctgaggtcgatgttgaattccggccaggtggccatggtcgccatcatcgcctggaaccacagcagcccagcgacgccgagctggcgcagggccaggcggttttcgctggccagttgttcgctggcgcgatcagcctgatagggatgggcggcgtaaccgatgtggcgcagttcggcgaggatctggctcagcggcaattgcgcgtcggtccagctcacgtgcaggcgatggttggacaggttcagccgcgcctcggcgacggcgggcagcgtgcgcaggtgtttttcaatcagccagccacacgcggcgcaactgatgccttccatcagcagggtggtttcggccagctccccttggtggcgcacaaagggttgctggacgtcggcgcgatcgtacagcgccagttcatcgaccaattgcaccggcaatgcttcggggttggccgaggcttcgctgcggtgttggtagtagctttccagaccgccggcgacgatggcttcggccacagcctgacagcccgggcagcagaactcgcgggattgtccgagcacgacagcggtgaagcggctgccagacggaacgggcagggcgcagtggtagcaggggagtgggctggtcatcgagtgttcactaatactgctgattcactacacccccgtgtaggagctgccgcaggctgcgatcttttgactttaaaacaagatcaaaagatcgcagcctgcggcagctcctacataggggtatcgggttacttcttgaggtcttcggcgccttgcagcggctcgtcacccagcagcagatccttgtcatggctcactagctcttcttcgaacatgcgccacacatggtcatcctgactgccgagcaattcgacaaaccggcgaccttcgaccttgtcgcccaattgaccgatgtagcggcctgcttcggtttcgctgcgggtcaggacgatcttgcgatccttttccggttgtgtcggcgaaatcaggttcaactcaagggtcttcggctggctgtcgccgctcaggcgcaaatcaacctcaccagtaacatcatccagatgcaccgccgcacgcatcttcaaattctgcgccaacaactcgcgatccagcgaacggttgatacccttgcccgcctcgtagtagttgtcgttgaccagattgtccgggttgttcaccgcaatggtcaccatcgacagagtcagggtcaccgaacaggccagaattccgatgatgatccatggccagaggtgcttgtaccaaggacttgcggcgtttgttgcgggcatgttcagttctctcaacggatttgggggccgatgaatcggctcttggcttcaacgtggacgctgtcgtcatcggcatccttgaggatgaatttcacctcgttggtgctcgatggcagttgttccggtgcgctcgacaactcgaccggcatgctgacgatgtcgccggccgcgaccttgatctcgcgcttgccttgcaggcgcagatccggcaacccggcggcttccagcacataggtgtgatcgcgctggtccttgttcatgatcttcaggctgtaaacgttttcgatccggccttcagcgttttcgcggtacagcacacggtccttgctgacatcgaaaccgaccagcgaacgcatgacgaacgcggtgaccagcaggctgatcatcgccagcaacaccacggcatagccgatcaggcgtggccgcagtttatgggttttctgtcccgacaggttgtgttcggtggtgtagctgatcaggccgcgcgggtaatccatcttgtccatgatgctgtcgcaggcgtcgatgcacgcggcgcaaccgatgcactcgatctgcaggccgtcgcggatgtcgatgccggtcgggcagacctgcacgcacatggtgcaatcgatgcagtcaccgaggcccagggccttgtagtcgatacctttcttgcgcgggccacggctttcgccgcgacgcggatcgtaggaaacgatcagcgtgtccttgtcgaacatcacgctctggaagcgcgcgtacgggcacatgtagatgcacacctgctcgcgcaaccagccggcgttgccgtaggtggcgagggtgaagaagccgacccagaaatacgaccagccatcggcctggccggtgaagaattcgaagaccagttcgcggatcggcgagaaataaccgacgaaggtcatgccggtgacgaagccgatcagcagccacatcacgtgcttggcggctttacgcaggaatttgttggcgctcatcggcgccttgtcgagcttgatgcgctggttgcggtcgccttcggtgaccttttcgcaccacatgaaaatccatgtccaaacactttgcgggcaggtgtacccgcaccagacgcggccggcataaacggtaatgaagaacaggccgaacgcagcgatgatcaagaggcccgaaagcaggatgaaatcctgtggccagaacgttgcaccgaagatgaagaatttgcgctctggcaagttccaccacacggcctggtggccgccccagttcagccacaccgtaccgaaatacagcaggaacaatgcggcgccgcccatcatccgcaagttgcggaacaggccggtgaaagcgcgggtgtagattttttctcgtgaggcgtaaaggtcaacgctgttgttcgcgtttttgcttggtggcgtgacgtcgtgtaccggaatctggttgctcatcattgcatcccacggcagtggaaaaatgcctcggtcgatacgtgccaaccgcggtcaaaatggggtgttgcagtggcgcaatgatacgcctgtcgctctggctcaagggtgcgacctttggtcgcgttgggggcgaagcctgaatggtgtagcgaatgtagcaaagcctgatgcaggtcaattgacttgttgagtatggacagttttggcgcggtcgctaattcattgttcccaggggtttatcagggaaacaccactcgattgaaagtcaccgacattgcgagtaacgacagtgagtccgtgaaccagcgcggtggctgcaatcaatgcgtcgctttcattggcctgatcgggtacatgcagactggcacaacgcagtgccacagcagcgtccaccggcaggattcgtgcgtcgaatgccggcatgacgtggcgcatcagccagctgcgcaaaaccttgccttgagcaggatcgcgccgttccatgcgtagcaccccggtttccagttctttcagggtaatggccgaaagatacaggcttggagccagcacgcttttcgcccaattgacgacattggcatcagcttgcggcttgcgaagttcggctatcacattggtgtcgagtaaatacatcaggatagatccacgggacgatgaatgatgaccgcacgctcggtttcgaattcgatgtcggcggcttccggcatgactagcaaatcaacaatgtttgcgtttgtaccgctcagttcctgatattcctcgatgctcagcaggacgtgagaagccttgccgcggtcggtaatgatcacagggcccaggcgtgcagccttcttggcgctgctggtgtcctggttgaactcacggctggagatggtggtgattgccatcatggtcgacctctcggattgcagatgtagcaacgttactacttcaccgtcagtgcggcaattggaaggagcagggctcatacgtccgttggtcgggcgatggctggcatgtgtggagacggcttcgcgcgaagcagaagccatctcggcttgaatcaggcttcgtttcaaaactcagggaagccgaccgccgcccaggctgtcgagactgccggtattcctgtgcggtttcgtggtgctgttggcatcgggttgcagcggcgtgcctaggctcagcacagcgggactcagggcgtgattcgatgagtcgcaagactgctcggtttcagcgaggtcctgctcgtctggtagttgcgtgttgtcatcattcaacatggcagcttcatccttgaagttactccgatgcggatcatcgggctgctgaaaaccctatcgccgatggtcaatcgagtccatcagacaagtgtctcaaggtatgaagcgccaacagaatagccccaccaatacacattggcggggccgtctgcttgccgctttatgtgcgtgatatccatgtgctggaaatataatcagttaattgtcaggttttaaagttgcgggcttctcgaataacttagttttttgcgctgttcttcggcagttgcgtattgatgtttatagaacaaggtaacaatggagtttcatgaatataaaggatgttaaaaaaactctcgccgggctgtgcctgtcatcgctggcttcttttgcccatgcagacgaaggcgttccacagcacatggtatttgcctcggacccccaatatccgtggacggaaaaatcggacagcggtgaagaggaatcgagcgcggactttgaaaaacgctcgaaatggctggttgaaagccaattcgcgagcattgcgcagttccgcaacgagatgggcgggcagagcacagtaccgctgatgatcaacggcgacatgaccgcgttcggccacggctggcaacgctcgtttatgggggggatgctgcagaaatattttgctgatgactatctttacgggctgggtaatcacgactatcagaacaatgtcaatgactgctttagcgagagttgcgcagcgggcagtatcgtcgattatcgcgatcatcatgttgataaggtcgatcagatggatcttgcagttaccggaggatttctcaataagcattatctgggaagtctggcttactcgaagagcattggtgaagtgcatctggtgcaactgaacaatgaaccgacttaccaagtgaagatttcccatgccttgaatccaaccacgttcgatatcaagcagtcgctggactggctggagaatgatttgcggatagcgcggatgcagggattggtgatcattatcaacatgcacaaaccctatgattgggcgggcagttgggatgagcaaaagcgctttcgcgcgatgatcgaaaagtaccaggtgacggcgatgttcgccggccatttccatgccgatggcggcagcatgagttacatcggcagcgtgccgatgttcctcagtggtgcggcctcgcggcaaacgtacctgactgccagtttttccagggatcgcaaacaactggaagtgagtctggtggagggcaaccagtggcgtgaacgtacgccggtggcaacggtgccggtaaagtcgatctttaccagtcgactataaaaaagcccccgccaggtgagtggcgagggctttcgttgcaacgcaaaccgggcttatcgggcgtcggcttctggtgctttttcaccgtgggacaggctgtaaacgtaagccgccagcaggtgcaccttgtcgttaccctgcagttgttcctgcgccggcatctggccctgacggccgtaacggatggtctgctgcagttgcgcgaagctcgagccgtagatgaatgcacccgggtgggtcaggtcaggcgcgcccatagcgggagtgcctttgccggccggaccgtggcaggccacgcagtttgcggcgaacagtttgccgccgttttccgggtcagccttggtgtcttccggcagtttgcggccatcgagtttggtcacgacgaatgccgcgacatcggccacgccttgctcgccaatcacttcagcccaggccggcatcaccgcgtgacgaccgcccatgatggtggtcttgatggtttccggctcgccgccccagcgccagtcggcgtcggtcaggttcgggaaaccgtaggcacccttggcgtcggaaccgtggcacaccgagcagttggaggcgaacaggcggccacccattttcagtgcttgcggatccttggcgacttcttcgatcggcatggcggcgaacttggcgaagatcggaccgaacttggcgtccgaacgggccatttccttttcccactcgtgcacgccggtccagccggtctggccgttggcgaacgcggtctgcttgtcgttatcgaggtagttgtaacccggcagcaggcctttccagttgcccagacccgggtacagcaccaggtaacccaaggcgaaaacgatggtgccgacaaacagcatgaaccaccatttcggcagtgggttgtcgtactcctcgatcccgtcgaaggagtgcccgaccgtctcgtccgtctgttcgctgcgctggcccttgcgggtcgacagcaacagccaggtcagggcgaagatcgtaccgagactgaggactgtgacgtacagactccagaatgtagtcattctttgttactcctagaagcttgctcgacgtgcttgatggcttcgggatcatccgcaaaaggcaacaaggtcgcgtcttcaaactccgacttgcgcttggggctgaacacccacaacgccagaccgatgaaggccaccatcacaacaacggtgcccaggccacgaatcatcccgatatccatctaattcaccgtttgcttttgatgatggtgcccaggccttgcagataggccaccagcgcgtccatttcggttttgcccttcacggcagcctgtgcaccggcgatgtcttcgtcggtgtaagggacgccgagggtgcgcaaaacctccattttcttggcggtttccttgccgtcgagcttgttttccacgaggaacgggtaagccggcattttcgactcaggcaccacgttgcgcgggttgtacaagtgcgcacgttgccagtcatcggagtaacgaccgccgacccgggccagatccggcccggtacgcttggaaccccacaggaacgggtgatcccagacgctttcacccgccaccgagtagtggccgtagcgttcggtttcggcgcggaacggacggatcatctgcgagtggcagccgacacagccgttggcgatgtaaacgtcgcggccttccagctccagtgccgaacgcggcttcatgccttcgaccggcttgttggtgacgtcctggaaaaacagcggaacgatttgggtcaggccgccaatgctgacggcgatgaccatgaagaaggccagcaggccaatattcttctcgacagcttcatgcttcatcagtgagctccaacgacagcgatctgggcagcagcttcggcttcagccgggttcgaggcgcgcacggtgcgccagacgttgtaagccatcaggaacatgccgctggcgaagaaagcgccgcccagggcacgaacgatgtaacccgggtggctggcctgcagcgcttcaacgaacgagtaggtgagggtgccgtcgtcgttgattgcacgccacatcaggccctgagtgatgccgttgacccacatcgacgcgatgtagagcacggtgccgatggtcgcgagccagaagtgcgcgttgatcaggccgacactgtgcatctgcgcacggccgaacagacgcgggatcatgtggtagatcgcgccgatcgagatcatcgctacccaaccgagagcgccggcgtgtacgtggccgatggtccagtcggtgtagtgtgagagcgagttgacagtcttgatcgccatcatcggaccttcgaaggtcgacatgccgtagaacgccagcgagaccacaagaaagcgcaggatcgggtcggtgcgcagcttatgccaggcgcccgagagggtcatcatgccgttgatcatgccgccccagcttggcgccagcaggatgatcgacatcgccatgcccaaagattgtgcccaatccggcagtgcggtgtagtgcaagtggtgcgggccggcccagatgtacagggtgatcagcgcccagaagtgcacgatcgacaggcgataggagtagatcggacgttcggcctgtttcggcacgaagtaatacatcatcccgaggaaaccggtggtcaggaagaagcccaccgcgttgtggccgtaccaccactggatcatcgcatccgtcgcgcccgagtaggcggagtaggacttgaacaggttcaccggcagggaagcgtggttgacgatgtgcaacatcgccgtgacgacgatgaacgcgccgtagaaccagttacccacatagatgtgcttggttttgcgcttggtgatggtgccgaagaacaccagaccgtaggtgacccagacaatggccagcaaaatggcgatcggccattccagttccgcatattccttggtggtggtgtaacccagcggcaaggtaatgatcgcgccgacgatcaccgcttgccagccccagaaggtgaaggccgcgaggctgtcggagatcagtcgcgtctggcaggttcgctgcacgacatagtaggaagtggcaaacagtgcacaaccaccgaaggcgaaaatcaccaggtttgtgtgcaacgggcgcaggcgtccaaagctcgtccacggcagaccgaagttcaattccggccagaccagttgcgaggcgatgaagacaccgagccccatgccaaggatcccccagaccaccgtcatgatggcgaactggcggactaccttatagttataagcagtcggactgattgctgtgctcattctaaggttccacggtttgggtgttttattaggattaaaatcggccgcaagtatgcagagagcagggggtcattgcaacgcgccatgacctgggtcaatgctttccaacgctgattctgcggcctttccatgcgccgcgtaaggacaaaattggcctcggacaaaatgtcgcagcggacgaaaaaagcgaggggttcaggtcgcttgtaacggggtgtgttcaaacgctcagttcgggtgacggatggcaaatggcacgacagccggtatctaccggcgtttgcggccacatcagtcagccggttcgcagaacacagcagtcagcgttgacctggaaccggcacaagccagtccgcatcgagcaagcgtagacccgaatccggggaaccgaaaggagagggtgcgaaggggtgcgacaatgcgtcgcaaaggggcaggatgctgccgcaccgagaaaggtgcggcagaggtgtatgcaatgattacttattgttgtcttcggtaatcagtttttctgtattcaatccgtgcgacaggctgtacacataagcggcgagcaattgcactttatcgttacccaacagctcgttctgcgccggcatatgaccctgacgaccatggcgaatggtttgctcgagttgggtcaggctggttccgtagataaacccggccgggtgcgtcagattcggcgcgcccatggcttcagtgccgtggccggttgccccgtgacaggctacgcaagtggtgctgaacgcctgctgtccggcttgcaggtcggccttgctgtcggcgggcaatggcaggccggccagctcgtgacgtacatacgcggccacgttcttcaccccggcctcgccgagcacttcgccccaggccggcatcgccgccatccggccacccatgatggtggtcttgatggtgtcggcgtcgccgccccagcgccagtcgctgtcggcgaggttagggaaaccgaacgcgcccttggcgtcggagccgtggcacaccgagcagttggaggcgaacagacggccacccattttcagcgcctgagggtccttcgccacttcctccaccggcatggcggcaaatttggcgaagatcggcccgaacttggcgtcggccttgttcatttccttttcccactcgtgcacaccggtccagccatcctcgtaaccgggcaggatgcctttccagttgcccagacccggatacaggatcagatagcccacggaaaacaccagcgtgccggcgaacagcatgaaccaccactgcggcagcgggttgtcgtactcctcgatgccgtcgaagctgtggcccatggtctggtcgacgctgcccttggtttcgccccggcgggtgccgatcagcagccacgtcaggccgatcaggctgccgatggtcagtacgcagatccacgtactccagaaggtggtcatggccgggtactccttgtttcagatgcttggttttgttcgggctgcggctcgtcggcaaacggcagcagacgtgcttcggcgaattccggggtgcgcttgcggttgaacacccacaaggtcaggccgacgaaggcgacgaacaccacgaccgtgccgagaccgcgaatcaggcctgcactcatctcaatgatcatcgtgctcacctcttgctcttgatcgcagtgccgagcacttgcaggtaggagacgagcgcgtccatctcggtcttgcccttgaggctggccaccgcgccgttaatgtcgtcgtcggtgtacggcacgccgagggtgcgcatggtcttgagcttggtttcggtgtggctgctgtcgaccgcttgcgtgaccagccatgggtaggccggcattttcgattccggtacgacgttgcgcgggttgtacaagtgcgcgcggtgccagtcatccgagtagcgcgcgccgacccgggccagatccggtccggtacgtttcgacccccagagaaacgggtgatcccacacgctttcaccggctaccgagtagtgcccgtagcgctcggtttcggcgcggaaagggcggatcatctgcgagtggcaaccgacgcagccttcgcggatatagatgtcgcggccttccagttgcagcgcggtgtagggcttcatgccctcgaccggtttgttggtgacgtcctggaagaacagcgggacgatctgggtcaggccgccgatgctcacggcaaacaccatgagcaacatcaacaggccgacgttcttttcaatcgtttcgtgtttcatggcggactcctcaggccatctgcgcggcagcgacgacttcagcaggctgcgaggcccgcacggtgcgccaggtgttgtaagccatcaggaacatgccgctgaggaagatcgccccaccaatcagccgcacgacgaagcctgggtggctggccaccagggtttcgacgaaggagtaggtcagcgtgccgtcctcgttcaccgcgcgccacatcaggccctgggcgatgccgttgacccacatcgaggcgatgtagagcacggtgccgatggtcgcgagccagaagtgcgcgttgatcaggccgacgctgtgcatctgcgctttgccgaagattttcgggatcatgtggtacagcgcgccgatggaaatcatcgccacccagccgagggcgccggcgtgtacgtggccgatggtccagtcggtgtagtgggagagggcgttgacggtcttgatcgccatcatcggcccttcgaaggtcgacatgccgtagaacgccagcgacaccacgaggaagcgcaggatcgggtcgctgcgcaacttatgccaggcgcccgagagggtcatcatgccgttgatcatgccgccccagctcggtgccagcagaatcagcgacatcaccatgcccagcgactgtgcccagtccggcagcgcggtgtagtgcaagtggtgcgggccggcccagatgtacagggtgatcaaggcccagaagtgcacgatcgacaggcgatacgaatacaccggacgttcggcctgtttcggcacgaagtagtacatcatcccgaggaaaccggcggtgaggaaaaaacctacggcgttgtggccgtaccaccattgcaccatcgcgtcggttgcaccggcgtacaccgagtaggacttggtgaaactcactggcaactcaaggttgttgacgatgtgcagaatcgccacggtgatgatgaacgcgccgaagaaccagttgcccacatagatatgcttggtcttgcgctgcatgatcgtgccgaagaacacgacggcgtaggcgacccagacaatggtaatcagaatgtcgatcggccattccagctcggcgtattccttggagctggtgtaacccagtggcaggctgatcgccgccaatagaatcaccagttgccagccccagaagcagaacgcggcgatttttggcgcaaacaattgggtctggcaggtgcgttgcaccgagtagaacgaactggcgaacagcgcacagccaccgaacgcgaagatcaccgcgttggtgtgcagcgggcgcagacggccgaaactggtccagggcaaattgaagttgagttcgggccagaccaattgggccgcgagaaaaaccccgagccccatgccgacgatgccccacaccaccgtcataatggcgaattggcggaccaccttgtagttgtaggcggtactgatagaagtgttcatggttccccatccacggttcagccgaagtgagcgcgcgcaaaacacgcggcgaatccttcgtctggagttataggcagactaaaagcgaggcaagcatggacaaacagcacaaggccagtattgacggggatcaatgggcgcagtgtgtgcgggatcgtgggtggctttgggatgctgccagtggtgaggctgcggcgacgttgatcctggctcacggtgccggtgcgccgatggatagcgagtggatgacggatatggctgggcgccttgccgggcttggggtgaacgtgttgcggtttgaatttgcgtatatggcgcagcggcgggtggatggggtgaagcggccgccgaatcctgctgcgaaactgcaggaatgttggcgtgaggtgtatgccgaggtgcggcgtcatgtcactggggttttggccgtgggcgggaagtctatgggtgggcggatggcgagtctgcttgctgatgagttgggggctgatgcgctggtgtgtttgggctatccgttttatgcggtggggaagccggagaagcctcgggttgagcatttggctggtttgaagacacggacgttgattgtgcagggggagcgggatgcgctgggcaatcgggaggcggttgaggcttacaccttgtcaccgagtattgaggtgacgtggttagctgccggcgatcatgacctcaagccattaaaggtttccgggtttacccatgagcagcatttggccagcgccgcgcagaaagtagccgagtttctcagcaactgaccgagctgggctgagattttgaactgcatgaagatcggctccctttccccctcgcccccttgggggcggtccgacgtttcgggagggctggggtgagggggatggatcttggatgcgctgctgtctttcgttttgggtacatatcctttcctgcggtaacggccactcagggttccgcccttacggcgggtcaccttttccaaacgccgaaaaggtaacccaaaaggcttgctcctacgtacggcccgctcgctggggctcggggtcccttcgctccgggatcgatccgggcgcagcgcctacggtttgcttcgctgcacctcctctcgctgtgtttggctgcgccaaacggtcgctacgctcccacgcccggatcaatccctccactcagccttccgacgtcgcccgtggatcaagatcaaaagcaggcgagctgacactcggcctattgagtggtgaagagcgggtgttcggcttttgttttgtggtgctcttgcccctcatcggaacgccgcccgcccagcccgctcccgagggagagggagccgatggtgggcctctcaaaatttgcgttcaactcggactttcacgtcggcgtaactctcccaaacacctcgatcagtcccctctccctctgggagagggctagggtgaggggctatttcgctgacacgataaaaaactggaagccctcactacccagcagttcctgtgcgtaaacatgattttgtgagcacgtttaaattacacaacccgttacgccactgggcctacaacaccttgcgccgttacctaagcgtacgccagaatccgccggcttacacgaccatagcgcgggctatatcgtttgcctgccactgcccatcagtggtcgggtttagtagcccgtatggttttagtaagtgcataggtcccattaagtcaggcgcatttgcctgcactcaatggtggctgtgctcagggcgctttcgagcgcgccggtcttgctaattcctccggtctactaacctgcgcacagccgccacccttcttttagtagagaacggtcgcggcccttgttcaggaattagatatttatgttcaaagccacgccaaactctccgggcaccgacccaacccctcacgacccagcgcttgagtctcaaaagacaaaagaagcaatcgatcgcgccctcgaccactacctcagaccagaagccctggcggccccgccaaactcgcccaggtttcgcccggtctatctcgtcgaccccacgctggatgacgaaaccctcctggtcgaggctagcgagtcgctttcatacgcccacgccatggccggtaacatcgccaactcaatcggcggcccggaacgcaagccgctgctggcgctgcaacaggtgatcatgctcaacgaactgttggtcaatcgactgttggataagctgaagttgcctcagtaatttcgccggctgttatggcctcatcgcgagcaggctcgctcctacattggatctgcggtgatcacagattgtgagcccgacaacgatcccctgtaggagtgagcctgctcgcgatgaggccagccagactccacaagtttcagatcaaaaacaaaaagcccggacagctttcgccgtccgggctttcaagatcaaaagatcgcagcctgcggcagctcctacgttggaatatattttcctgcagggattgccccaggctacgatctttttgatttacgttgtaatggttagcctgccagtgatcacaaattcatcgaacactttctgcccatcacgcgcggcttgccgaacatcaaggaatgtcagttcttcacaaactttctgtttgtcgggttttcgggtggagtgtgtattcatgcgggctggcctgcgtgattgagtcgcgaccggcaaacaatagaacctggcctcaacgagcaccagtcgccgcctacttcacgctttgcacgtgcatatccaccgcaatcccgtcgcctttatccgtactggcgtgatagaaaaaaccgtaatccaccagatagtaataatgatccattggcacgggcttcaagctcttgcgctgatcacggcaactgatcgctttggcgttaccactcaacgccgggttcagcagtttggcgggtgactcgctgtcgacggtgcaatccacggtaaccggttcttcccccagcgagccgatcaggttgctgttgatgctgccttggcgggtgtagcccagttggctgccgacgcgcatttgctgccaatcacctcggaaactcaaattgtcgatcacaagggtgttgcgggacagtttggcctgttcccgaccggacagggtgagcaggccccgccagctgatttgatggccgacgaggttttcgctcttatggtcaatgctcagttgttggctgaccgggtcggtggaaatgaagtattcggtgcgttccggccagctctttttgctattgctggcggtcccggcgaggtccaggtaagtcagggtcttgagtggtttcggcaggtgcagctgttcgatgtttttcagcacgttcgggctgatgtcggggatagcgttggcatctaccgccgctttgctgcgtcgggtcagcgccggcaggctggcgatggacgttggtgcgttgcacaccagttcaaccatctttgacttgtccgcctcggacgccgtgattactttggtctcggggaacatgtcgattttgccgtcggtgacctggttgtcggcgttgaggaaatagcgggccagcagcgtggaattgcgtgtggcgcaatcgaacgtgtaatgctcgcgagtttgggtgaacggtgcgctattgaccaggttgaggcgggttttcggctcgtcgtaggccatccatacatcgacttgcccggccttgttttgcaggttgtttttatcgaccagcaaccagcgacccgtgtcgtcttccgccactttgcgccaatcggcgacgggcaggtttttgcatgcctggaggaagtcgcggttgttcagcagtgtggcgtggtaacgctcgggcaacgccctcgccggcgcatagtgacccggattgcccggataaatgtggcgcatcaacaggaatgaatacacttcgttgatctgcgccgtgctgcaggccgccgagtactggaagcgctgcaccaccacggattgcggatcgcgcggctcgatcacctgaaagttgatgacgtcgccttcacgcatcaggctgttgggcgtcaacggctgggccagcaacactgcctggcggtcggtatttttgggctgggtgacgcaagcggccagcagcaatgtgctgatgcaaagaatgatgcgctgcacggaactctccgggggatcgattgaaagaggcattacgattcatatagctctgcttgggctcagcgcagcgccatcacccttactcgttcaaatccttgaccagatagtcgccgacaatctgcgaaacaccggtcaacgcggtgcgtaccagttccggttcagtgcgatagcgcagcggctcataaccgtaggtgttggcgccgttaaacgcggtgatcggctcgttgcgctgccagatcaactcgtcgccgcgcttcatcacgccgttgaccgcgatggtcgggtaaaccacgctgctgaagccctgggtcagggcgaagccccagttgaatacggtcagttcaatctgcgcgtccgccggttcgttgtcgccgacgattttgaagcggccgctggcggcgagtttttcttcgaagctcgttttcaccaagtcgccgaggttgatgttggcggtttccatgttgtacaggatcgcatcgacggtcgacatggaggccaagtcgccggccttcataccagcggcaaaaccggcaccgccgagtgccgccgtaccgattttgccagcgcccgccgccagacctacgccggtgccgacgcccgcgccaatggcggcgccccatgcttgttcgcggcccatatagctcatttcccggggtttccatgacaccgcgaggattttcacggtgtggatttgggtacggtattcgggcttgaatttctggttggcgcatccggccaggaacagaacggcgaacatcaggacagcgatcttcttcatgaaggactcacaacaagaaacggacttgcggaggttgtcgtccgcatgcaggaattctgaaggggtgatggctattaatgtgccactatcgcggcgatcgagttccggcgcctgaatgccgctgccgccagcaggtggaagcgcgcatcggaaaactcgctggacacacacagccccacacgctgacgtctcgcgctctattgcgagagattcccagcgatgcgcgctgtgccacgggccggatatcaaaggcacggggccgttggcgaaaaagagcaatccgtccacacctgacctgaccacccccgcgttcaagcaacggctaaatgattacccgggggtgattgtgtcttcggtgatcctgcgcccgaacggcaatctgataccgaaaaccttgcaggagaattcaaaaagatcgcagcctgcggcagctcctacacggattatctgtaggagctgccgcaggctgcgatctttttgctgttagcggttaaaccgctccaccaacgaatattgcgtgttagccgtcttcgtcagctcttcactcagcaacgccgagttatgcgcctgctccgacgtctgatccgccaactccgaaatattgctgatgttgcggctgatttcttcagccacggcactttgctcttcggtcgcggcggcgatctgggtggtcatgtcggtgatgttggccaccgcttcgctgatgccgaccagtgcctgatccgcttccagcacccgcgccacaccttcttccgcttggcgatggccggcttccatggtttgcacggcgctggacgcggtctgctgcaacttggcgatcagggcatgaatctgcccggtcgattcgctggtgcgttgcgccagttgacgcacttcgtcagctactaccgcgaagccacggcccatctcgccagcacgtgcagcttcgatggcggcgttgagcgcgagcaggttggtctggtcggcgatgcctttgatcacatcaaccacgccgccgatttcgtcgctgtccttggccagttgggtcacggtcaggccggtttcccccacgaccacggacagacgctgaatggcttcgcgggtttccccggcgatgtcacggccgcgaccggtcaggcgattggcttcctgagtggcgtcagcagtgcgctggacgtggctcgccacttcttgcgtggtcgcggccatctggttgacggcggtggcgacctgttcggtttccacgcgctgacgttccagaccagtggagctgttgtgcgccagggcgtcggactgcttggcctgatcggtcaggtgttcggcggtgtcctgcaggcgggtcaggcaggttttcaggcgtgcctcctggctgaggatcgacatttccagacgcgcctgcgcgccacggctgtcggtgtacatctgcgcgatcaacgggtcagaggtggtctgctcggccagacgcagcaggcgcttgagcccgcgttgctgccattgcaggcccatcaggcccagcggcaccgacagaccggcggcgagagcgaagccccactgcgagttcagggtcgcgccgatcacgaagctcagttggctgaccagaatgaacggcagccagtcctgcagcaccggtagccatttgtcgctggaagggatcgccgacttgccttggttgatgcgttggtagagcgcttcggcacggcggatctgttcggcggtgggtttgatccgcaccgactcgtaaccgaccacctgattgccgtcgaacaccggtgttacataggcgttaacccagtaatggtcaccggtcttgcagcgattcttgacaatgcccatccatggcaagccttgtttcagtgtgccccacatgtgcgaaaacaccgccgccgggacgtcggggtgacggaccaggttgtgcggcgcacggatcagctcttcacgcgaaaacccgctgatttcgacgaaagcgtcgttgcagtaggtgatcacgcccttggcgtcggttgtggaaatcaaccgctgctgagccggaaaagtccgttcgcgttgtgtaatgggctggttattacgcatggtttttcaatccgcaaggctttgaaaggttgtcggcggtgacagctgattattgaaaatttttttcaataatcagcacagcgtcgcaaaacggcgcttgcttcagccggcgagcatcggataggtgaacaggccgaaatgcagcaggttcaggccgaaatgcgtgacgatcgccgcgccgagtccgccaaaacgataggccagaccatagccgacccccgccagccctgccagcaacacccagctccagcccgcgccggcatgcaccagaccaaacagcagcgaggccagcagcagggcgaggttgtcgccgtacggcaggtgtttgaagcgctggctgaggccgccctgtatatagccgcgaaacagcgcttcttcgaccaaggtcaccagcagcagattattgagcacccacagccacgcctgatccggccacttcggcgcccaggcaatcacacccagcaacagcgcgccgccgagggccagaaccgcgctcagcgtcagggcgagggcggtggcgtagacgctcaggcgcaacgaacggcgcccgacaatccacgggcacaccagcagcaaccagaaaccaatcagcggtttatccagattcaggtacatcgagaacggcacggcgttgtcggtgaagcgctgcggatcgatagcccgaccgttggcgaaacccggtaaccagtgcagcgccaacgccacggccaacacgatgaacagcccatgaccaagaaaacgcgcgaccggcacctgttgctggcgcacggcaaaaccggcgaacaccagcagccccacggaaatcaaagcgagccagccgaggtggccgtagctcagcgcccatccataaccgaggctgagaagcgccagatagagccatggcaaagccttcatcgaaagtccctgtgcaaatttgtggaagcgctttctacacgggcgagggcttggggacaagtgaaggtgtggcggtgatcggggacaacccaaatttccttggtaacccgatcaactgtaggagtgagcctgctcgcgatagcggtgtgtcattcaacgcagatgttggctgatccaccgctatcgcgagcaggctcactcctacagggttttgtatttggctgacgaatcagtgcaagttgagtttggcggcagcgcgctcggtaatttccgtacgtagcttcagcgatggcgctgcacgcaaacgggcctcatcgacaaccgcacccggcgcagtctccgggctgccggaattgaacggcggtgccggggcatattccaattgcaactggatcagttgcgccgcgtcggcacccaccaactcttcagccaataccaaggcaaaatcgatccccgccgtaatcccgccaccggtaaacagattgccgtcacgcaccacccgatctttcaccgcaatcgcacccagcgtcggcagcagatcgtgatacgcccaatgcgtggtcgcgcgtttgccttgcagcaggcccgccgcgcctaggaccagcgaaccggtgcacaccgatgtcacgtacttcgcctgaagggcctggcgtttgatgaagtccagcgtctgcgcgtcttccatcaacggcccgacaccgccgccaccgggaatgcagatcacatccagacacgggcaattctcgaatgtggtggtcggtttcagcagcagcccggtgctggcggtgaccggcatcagatccttccagatcagatgcacctgtacgtccggcaacgaggcaagcacgtcataagggccggtcaggtcgagttgctgaacctgtggaaacaacagaaaaccgatctgcaacgtcatcgttcttgctccatgaaaaggggtggacgtcttcactgtaggcgcgtaggttctggcgcatacgccaataaccccacgaattacgccaaatgcccaaagccatccacgtactcgcgtttgccaacatgcagatcctcgacgtcaccgggccgctgcaggtgttcgcctcggccaacgacatcgctcgtcaacgcggtttgccgataccctattcgccgagcgtgattgccagcggcggcggggcggtgatgtcgtcggcagggttggcggtgttggccgagccgttgcctgaagcgcccagcgatacgttgatcatcgccggtggctggggcatttatcctgccgctgaagatgtgcttttggtcgattgggtacgcgagcacgccgtcagatgtcggcgcgtggcctcggtgtgcacaggtgcttttttgctggccgccagtggctggctcgacggtcgtcgcgtggtcacccactggactcgctgcgaacaactggcgcagcaacaccccaatctgcacgttgaagcgaatccgattttcatcaacgacggcccggtgtggacctcggcgggtgtcaccgctggcatcgacttggctttggcaatggtcgaagaagatctgggcagcgacatcgcattggatgtcgcccgccatctggtggtgttcctaaagcgcccgggcgggcaatcgcagttcagcgtgactttgtcgttgcagaatcagggcaatcgttttgatgagttgcacgcgtggatcgctgagaacctcacctgcgacctcggcgtcccgacccttgccgagcaggccggcatgagtgaacgcagtttcgtccgccattaccgcgccgacaccggccagaccccggcgcgggccatcgaaatgatccgcgtcgaaaccgcccggcgattgctcagtgacactggtctgccggtcaaacgcatcgcggccaattgcgggtttggcagtgaagagacgttgcgtcgtagttttctgcgggcgattggcgtaacgccgcaggcttatcgcgagcggttttcggtcagtgctgcaacagatccagtaatgccttgagggtttgttcaggggcttcctcgggaatgttatggccgacatcgggcaacacacgccgctcatagaagccggtgaaatgctctgcgtcttcatcctcttgtggtgcagggccgacaccgtcgtcggcaccgcacaaagaaatggtcggcacgctaatggtcggttgccgagtcagcaaatcttccatcaactcaaacgccggatctcccgcgacgtacatgaagcggtggcgataggagtggatcaccacgtcaacgaaatcggggttgtcgaagacaggcgcagtcagggggaaacgcttggcggcgtgcgaccaggtcggagaccaaagcctccagagcagctcacaaaactcccgacgattgtgcttcaggccctcaacgccacgtggcgtgtggaagtaatactgataccagagccgatgttcggtctcgggatccagcggtcgaatcgagttggggatgtcctgcaggttgtagccatcaccggtcaccaagccgcgcactcgttccgcaaataacgccgcgacgatacatgccgcgcgaccaccccagtcatacccgcagagcgtggcttgttggatggagagtgcatccatcaaattcagcaaatcctgggcgagtgcggcttgctggcctgagcgcagtgtttgtgcatcgttgaagcgagtctgcccgtaaccgcgcaggtacggaacgacgactcggtaaccctgagcggcgaggagcggcgcgatttcgtcgtaagcgcgaggggagtacgggaagccgtgaaggaggatcaccggcgcaccggtttccgggccatgcgcctcataggcaatggtcaggctagcggttttgcaaaacagaatcgcttttccactcataccgggctcctgttatccgaacaacaccttctgccaatgatcttcactgatgatggcgatcggcacgccgctgtctctcagctcaacggcttttttgatcttcgtaccatagctgctgtgcagccactgttcattgccgatgctgccgatcactagatagtggattttcttgctgacacctgcaccaatcattccgccgcgttctacgatcagcgattcacacgctttgcgcggcccgtaagccataacaccggtaaacagaaaaacacgattggcacagtccagggatggggctggactatcgagcggcaggctgttgggcacgctgaaggtttgtgctgcgcccactggcaggccggcgaactgatgaagaatctccagcaattccaccgattcatcggcatccagtacaccgtcgctaagcatgcccccaagacgcttgtagagaatatttaccaccggatcccccaagtgaaccaagtgggtttcgatccaggtcttgagaaactcggcttcctgctgattgatcttgccatcagcggctagcccggcagcgacccctgccagtgcgtcggccgaacgcctgtcaatccgcgcttcgtgaaagaaacggctgttatgaaattcctgatgcaaatcgaccatcgctgcttctccttaagcctcggcttccgccacctgattgaaatacttcgtccgatccggagtaaacgtcacccgcatcttcgtccgcgaacaggtcaacgaacgttcttcgctcatatcaatatccagatcctcgccgcgcaagccttgccactgcgccagatacttcaacgagccatatttttcggttttcttcaggctgcggctcacgccacctttccagccgagcactggcagttcgtcggcgaggcagcgttgggcgaggtcggggaagcgggtggcgcgttggcggccgatttcccagcatttgatcaggcctttgtccgcggcttcccagagttggctgcgggtcaggccgctgcgaaggggcgtgtcgattgtgcgctggacgtgctgggacattctggttccttgaattcgggttttattggacagctccgctgtgcccgttgcggtggatggtagggggggatgtaacagctggcaacagggtatttccgggtgtgactgcgaggttcgggggagggtggacgcggcggatgttgatcacctgtagtccattgccatgcgaatttgtggcgaggggatttatccccgatgggctgcgcagcagccccgaagtgagaaaacccggtacttctgggggaatgggttggagggttttgggcctgctttgcagcccatcggggataaatcccctcgccacaggggtcctacaaggtcttcgttttgtgggctatttcctacaaccactggcgaacattacggctgccactcactcttttccccactcaaccgacgatccagaaaactcgccgcgctgatcaacgccagatgcgtcagcgcttgcggtgtattgcccaaatgccggccatggctgtcgaactcttcggcatacaacccgagcgggttggcgtaacgcagcagttgttcaaactccagatgggccttttccacctgcccggcgcgagcaaggcattcgacgtaccagaacgaacacgcagcgaaagcgccttcggtgccggccagaccatcgatattgctgtcgtcgttgcgatagcgatacaccatgccgtcgcgcaccagatgtttttcaatcgcctcaagcgtcgacagccagcgcggatccttggcgctaacgaagcgcaccagcggcatcaacaacatcgaaccatccagcgcggtgccgcccttgtactgcacgaaatgcccgcgctcttcattccagaagttgtcccagatgtcggcgtagatcgcctgtcgggtctggtcccactgcgcgaatggcgccggcagcgagcgtttcgaggccagtcggatggcccggtccagcgccacccagcacatcagccgcgagtgcagaaagtggtgctgttcaccgcgcatctcccaaatgccgacgtctttggtctgccacgtctcacagacttgatcgaccacttcgcgcacgtgtttccagccttcgtgggaaattgcgtcgccgtatttgttgaccagatacaccgcgtccatcagctcgccaaagatatcgagttggatctgatcgtaagcgccgttgccgatgcgcaccggttttgctccgccgtgccccgagaggtgatcaagttcggtttccggtaattcctgacggccatcgatggcgtagagaatgttcagcttcatcggttcgccacagcagtcgctgacccgcccgcgcaaccagcccatataagcgttggcttcgccgacaaaacccaggcgcatgaacgcgtacaccgtgaacgaggcatcgcggatccatgtgtagcgataatcccagttgcgttcgccccccggcgtttccggcaggccgaaggtggcggcggcgagaatggcgccgtgtttgcgcgatgtgagcagtttcaacgcaagggccgaacggttgaccatttcgcgccagcgtccgcgatagattgactgaccgagccagtcgcgccagaacttcaatgtgcgttccatgcacagttgcgcggcacctgccgcgaaacgcggatcgtcttcgccacccagcatgaacgcagcagtctgatcctgtttcagggtaaatgaggcaaccgctgcgtcggtttcgatgtgcaacggctgatccgaagtcagacgcatcgatggctgcccatcggcactgaaaatcaccgcttgctggtccatccgcgcacaggtgtcggcgcgcgcgtagtcatggcgcaccgcgcaacgcacgttgaaggtcgcctcaccgctgaccacgcggacccggcgcatcagcagcggcaaatcgtcctcgttgtccgccaccggcaacagatcggtgacttccaccaccgcacgctcactcagccagcgggtttgcagcacattggtgtcgggcaggtaaatctgctcgcggcgcgcatcgggcaagtccggcgccaactgaaaaatccccgcgtcggggctgtccagcaacgaacagaaaatcgacgggctgtcgaactccggccagcagaagaaatccacgctaccgcgatcattgatcagcgctgcactgcgcatgtcaccgatgatgccgtgggcatcgatcggactttgtcgttccaggtgatgctcagccattgccgcgaaactccggatagaggctcatgccgccgtcgatgaacagggtggtgccgacgatgtaatcggaggcatccgaggcgagaaagaccacggcgttggcgatgtcttccgcgtcgccgatgcgtccgtaggggatcagctccagcagcttgtcgccggcagcgccttcggtcgcgtctttgttgattgccgtgcgaatcgcccccggcgcgatgccgttgacgcgaatgcgttgatggctgacttcctgggcgagggtttgcatcaactgatcgacgccgcccttggacgccgcgtaattgacgtgcccggcccaaggaatgcgctggtgcaccgaactcatgtggatgatcttgccggccgcgcgcgacacgccttcgcgaatgccctggcgattgaagatgcgcagggcggcgcgagcgcagaggaactgcccggtgaggttgacgctgatcactgcgttccagtcgtcgagggtcatgtccacggcggcagcgtctttttgcatgcccgagttggccaccagaatgtccagcgagccgaaggcctcgacggtttcggcaaataaccgttcaacctcgttttcttttgacacgtcggcaccgatggccagcgcctgaccgccctcggcaatgatctgccgggccagtgcttcggccggttcggcctgacggttgtagttgatgaccactgcggcgccggcagcggcgagggctttggcggcagcgtggccgatgccggagctggcgccggtgatcagggctacttgtccggtgagggagatttgcatgcagggtcgcgccttgagtcgaggacttatctagctgactgacaggcggcgacgagagttcatccgtaatcatgaaaagttcgacaccttcacacctgataacggccactggtgcgatgccattcgacattgcccgccagccagctcttgattcctcgcaaatagcgtttgagcagcggcgatgcgcccggcaagacggccagctctgcggcttcatacagatgcatgatctcgtcatggatagcggcgctttgcgccatggcctgttgcggcgagcattgctgctcacgcatcagcagcaacggtaaattgaaatcaccaatgccggcctgctgttccttcaacgccgaaaacaggtcgttggcaatgatcgtggcgctggcagccagtgtcgtcacccgccgcacttgcggtgcgctgtagacattggcgggcaattcatagtcaccgacaatgtcgacgagcgacaggcatgggaggaaactgttgacctggcggtgggcgaggtactcccagagcgccggcgtgaggccttcgatgcgccaggcggcttcggctgtcatggttacgaacatggcgatgatttcatggcgtacgcgtgcgacctgtgcaggtctcgcgaaggcctccacccgcgccagataggcctgcagtgcgaccaataccggatcgccacacaaggcctgtgccagaccagggcgaaaccgttcgctcaaataaaccggttccagcgcggccagcgcgacggacaggcgcgggccgaccagtttgggttcagccccggttctttcatcatcacagtagtaatcatcgacggcgaacagcgcggcaacacattgcgctgccagcaacacacggtccggatcctccgtgtcggtatgacacagcatggcgaagcgcccaaagcccatcgcgcggactttttcgagttggcccggaaagatcccgacctgctcgatccatggcatgagctgttcatccactgcctcggccagcgcagcatcgacccgaaagggagcagggcagtacaacggtgggatggcccagggcgaatccatacgaacaacgtttcgcggcggcgatgatggtgaagcggtgcgcgcgcgcactgcctcgaaccagcctcgcaccccctctatcccgaactgctcgaacatccgccgaaaccagaccgtgaagacgttgggcgtctgctcgatgcgctccgcgatttgcggtagcgccagccactcccagctttcggcttcatcaggattggccaccggatcggtctgactgataccggcaaacacatgatcgaactcatgctcgatcagttgatcggacacttgctcgtggtagagcatcgaggcgactttgtgcagcttgcaggtcatgcccatttcttcctgcagtcgacggttgacagcgactgccgtccgttcgcccgcgcgaggatgcccgcagcaggtgttggtccataacccgccggaatgatatttgcccagcgcgcgttgctgcatcagcagccggccctgcggatcgaacagcagaatggaaaacgcccgatggcgcaggccctggtgatgcacttgcatttttgcggccacgccggtctggcgatccttgggtgagacgagaatgagctgttcatccatggcagggctcccgagtatgtttgctgccagatagttcccatgcacgttgcctgttcatcaggagcgctgcgcagttgagcgacggattaatgaaaacttgtgtggcggaacaaggcacctgtcagatctgacaggtctgccaggttttcgacaaatggtcgttgtgattcgagaggttgacggccatttcggctgtatcaggcatcggtcgtcagcgcatgagtcgaaccgcaggccgtagtcgagcaccttcacattccaccaacaattgtgcgctttgcgacctgcaagccttatggcaacttggcggcccctgatgaggcagcacccatggcaaacccctaccgcgaattattcacagcccccggcgcacgcaattttgtcctggccggaatgatcgcgcgcatgccgatctccatgaccggtatcggcgtgatcaccatgctctcgcagttgaagggcggctatgcgttggccggtggtgtggcggcgacgtttgccctggcgacggcgttttgcgcgccgcaggtgtcgcgactggtggaccgcttcgggcaggggaaaattctcccggtgtcggcgttgatcggcggcggcgcactgctgatgttgctgctgtgcacgcggttgcaagcgccaaactggacgctgttcatcttcgccgcgctggccgggtgcatgccgagcatgtcggcaatggtgcgtgcgcgctggaccgagatctatcgcggtcagccgcaattgcagacggcctatgcgctggagtcggtgctggatgaagtgtgctttatcgtcggcccgccattgtcggtggggttgtgcgtggcggtgtttccagaggcgggaccgctggcggcgctgctggcgctggcgattggcgtgacggcgtttgtcgcccagcgcagcaccgagccggcggtgcatccgcactcgtccgaagatcagggctcgatcattggttcgaccgacgttcaattactgctggcgctgatgatcgccatgggcgttattgtcggcgtgattgatgtagtcagcgttgcgtttgcccaacagcaagggcagccggcggccgcgagcatcgtgctgtcggtgtacgcgatcggttcgtgcctggccggcatcgccttcggtgcgatgcgctcgaaattgccattgccgcagttgttcctgtacggcggcgtggcgacggcggtgacgacgttgccgctgttgctggcgagcaatatttttggcttgtcgctggccgtgttcgttgccgggctgttcttctcgccgacgctgattgtggcgatggcgttgattgaacgcattgtgccagcggccaaacttaccgaagggttgacctggctggtgaccggtttgagtatcggcgtggctgtcggggccgccggctccggttggctggtggacgccttcggtgcgcgcagcggtttctggctggcgattgtggcgggggccgtggtgcttggctcggcaatccagagttaccgccatctcaagtaggagctgcggcacgctgcgatcttttgatcttgatcgttaaagtcaaaagatcgcagcctcgtttcactcgacagctcctacaaagtggaggtggcaactgtttaccagccccgtcccgaattcacccagaaattcaccgacagtgatgtcgacaccgattccacctgatggaaccagccctccggcaaaaacagcaaatcccctgcctccagcgtcacccgcagaaatgtcacgtcgcgggcggcaggaaaacgctcgtagtccggcgcatccgggttgaaatcacagccatccagcccgcccttgggcgccgtcgaccaggtgcccagcgcttcacggtgatgcggcgcggcgagggtgaaggtcttctgcccccaaacctgcgcgaagaggttgtcggtgtcgtcacgatgcaacggcgtcaacgtgcctttcggcccgatccagattcgcggcggaataaacagcgaggtgtcgaagtagggcgggtacttgatctgctgcatcaattgcgccggcaggatgttgttgcccatgtaggcgggtggttcgccattcgcacctttgaccgccggttgatccagcgaggcgatgaagtcggccatcgacgtggagcgaaaatcacgttcggtggagaaggttttcttcacgtaatcgccatggcgggtgatgccttgcagctcggcgaaatgcaccagcgattcttcgcggctgagcttgaacagtggccagtcgtgcagcgcattgctgatcaccaccggaatgccattgggcaggtagcggctgttgaattcggcgaccgacagatcactgcgggcaaggcgttcgacgctgctttgggttggcaggctggcagtgagtttttcgctgaagcgcggcggagtcgggtagcgcttgttcatgtcgactttttccgccacggcgccaccgtgcatcgcatgttcgatgatctgcggcagcatcgttgccaggcccatgttgccgccgattttcaggcgcccgctggcgaacagctcttcgacgttggccatgccgctcatgatcccgaggaaatcgcgctcggcgacttcaatggtcacgtccgggctggcgtggcgtccgggctcggtgcggctgctggccttgacctcggaccagtaggcctgctgcggaccaaacacgaattggaaaacgccttcgatgccgacggcaccggcattggcgaacagcttgcccaggatgctctgcaggtccacggtgaatcctcgttattggttttggcctgaacagttaacgagcgcctgcggggggaatttaccggtcgacgactaatttaaccgccacgggatccgtttctctctacaagtgaatttttcgaggaaagcgtggtgaccaagctgaccctgctgtgcctgccgtattccggcgccagtgccatggtctacagccgctggcggccgaaactgccgcagtggttgcagttgcaaccggttgagctgccgggacgtggcgcacgtttcggcgagccactgcataccgacatgcgtgcattggcgatgcaactggccaaggagctgcgcccgacactcaaagtcccttatgcactgttcggccacagccttggcgcgttgctggcctgcgaaatggcgcacgccctgcgtgcgctgggttgcccggaaccggtggcgatgttcgcttccggcacggcggcgccgaccctgcgtgccgattacgatcgcggctttgccgagcccaagaccgacgccgagttgatcgagcaactgcgcacgctcaatggcaccagcgaggaagtgctggccaacgaagagctgatgagcttgaccttgccgatcctgcgcgcggatttcctgttgtgcggcaagttcgagccgctggcgcgaccgctgctcaactgcccggtgcatgtgctcggcggcaaggctgaccgcgccaccaccgagcaattgatcggctggagcaaggaaacccgtggcagcttctcggtggacatgctcgcgggtgggcacttctttattcatgagcatgaagcgaaggtattgaaggtgatcaaggatcagctcgatgtgcatcatcgccgccacgccatggccgcgactgcctgaacgccgaaaaaatccctgtgggagcgagcctgctcgcgaatgcgccgtgtcagccaatatagatggcgcctgacacaccgcgttcgcgagcaggctcgctcccacaatgatttgcacatgtctcaaaccctcgcatagccccgcctgacagttgttctcattcgctaatttttccggtctgcattcgttttatagggacgacgtgcctttgtgcttcctgcctactgatccggatgctaagaaatgaatgctgaagactccttgaaactcgctcgccggtttatcgggttgcccctggaaaagcgccagatgttcctcgctgccctgcagagggaaggggtggatttttcccggtttccgattccgaccggcgtcgaggccgaggatcggcaggcgctgtcttacgcacagcaacgcatgtggtttctctggcagctggatccccaaggtggcgcctataacctgccaggcgcggtacggctcaatggccgtttgaacgtggcggcgctggagcaagccttcgccagcctggtcgagcgccacgaaaccctgcgtacggtgttccagcgccaggccgatgacagtctgtcgcaagtgccggccagcgcgccgttggtgatccgtcatgaagacttcagcgcactgccggccagcgagcgtgagcaggctgtggtgcaggccgccgaacaacagtcggtgttgccattcgacctggccgtgggtccgctgctgcgggtgacgttgctcaaactcgccgatcaggagcatgtgttgctgctgaccctgcaccacatcgtttccgatggctggtcgatgaacgtattgatcgacgagttcatccgttgctacgacgcgttcgatgccggtcagccaccgcaactggccgcgctgccgatccagtacagcgactacgccttgtggcaacgccgctggctcgaagcgggcgaacaggcgcgccaactcgattactggcaggcgcaactgggtgacgaacacccggtgctggagctgccgctggatcattcgcgtccggcgatgccgagctatcgcggcactcgctatgaattcgctgtcgatgaacaactggccgagcaactgcgcaacaccgcgcagcagcatcaagtcacgttgttcatgctcttgctcggtgctttcaacgcgctgctgcatcgctacaccggccagaccgacatccgtgtcggcgtgccgattgccaaccgcaaccgtggcgaaatcgaagggctgatcggcttcttcgtcaacactcaagtgctgcgtacccaactggacgggcagacccgcattgacgatctgctgcggtccgtcaaggacaccgcgctcggtgctcaggcgcatcaggatctgccgttcgagcaactggtcgaggcgctgaagctggaacgcagcctcagtcatacgccgctgttccaggtgatgtacaaccaccagccgcaagtggcggacatcgccagcatcagcactgcctccggtctactgttgaacagtcttgactggcagagccgtaccacccagttcgacctgaccctcgatacctacgagaagggcggcaagctgcacgcggcgctgacgtacgccagcgacttgttcgagccggccaccatcgagcgcatggcgcgccactggttgcgcttgctcaaggccatggtcgccgatccgtcgcaacgcatcggcgaactgccgctgctggaggccgatgagcagcacacgctggtgcatgactggaacaacgtacacgcggtttatccgaccgaaacaccaatccaccaactgatcgaagcgcaggttgcgcgcacgccgaatgcgcctgcgctactgttcggtgagcagacgctgagctacgccgaactggatgcgcgggccaaccgcctcgcgcatttgctggttgaacaaggcgtgcgggccgacagtctggtcggcgtttgtgctctgcgttcggtggaaatggttgtcgcgctgctggcgactctcaaggctggcggcgcttatgtgccactggatccggagtacccgcaggagcgtctggcgtacatgatcgaggacagcggcatcaccttgctgctgacccaggatgctttgctggcatcgctgccgactgacggcgtgcaggtcatcacgctggatcagccgggcctgctcgaccgctacagcgacagccgtccgaacgtcagcatcgatccgctgaacctggcctatgtgatttacacctcgggttccaccggcaaaccgaaaggcgccggcaacagccacgcggcgctggtcaaccgcttgtgctggatgcaggaagcgtacgcgatcgacgccagcgattcggtgttgcagaagaccccgttcagtttcgacgtgtcggtctgggagtttttctggccgctgctgaccggtgcgcgtctggtggttgccgcgccaggtgcgcaccgcgatccgctgcaactgatcgacatcatcaaccgccacggcatcagtacgttgcactttgtgccgtcgatgttgcaggcgttcattcatgaggccggtgtcgaaagctgcatgggcctcaagcgcatcgtctgcagcggtgaagcattgccgctggatgcgcaattgcaagtcttcgccaaactgccgaacgccggcctctacaacctctacggcccgaccgaagcggccatcgacgtgacccactggacctgcgttgacgaaggcgcggacagcgtgccgatcggccggccgatcgccaacctgcgcacccacgtcctcgatgctgagttgctgccggtgccaagtggcgtggccggcgaactgtacctgggcggagccggtctggcgcgcagttatcaccagcgtccggcgctgaccgccgagcggtttgtgccgtgcccgttccacgacggcgcgcgcctgtatcgcaccggtgaccgtgtgcgtcagcgtgccgacggtgtgatcgaataccttggtcgtctcgaccatcaagtgaaactgcgcggtctgcgcatcgaactgggcgaaatcgaaacccgcctgatgcagcatccgctggtgcgcgaagcggtggtgctggtgcagggtggcaaacatctggtggcataccttgtgttggaacaggctcagccggacgagcagtggcagcaggacgtcaaggcgtggctgctcggcagcctgccggaattcatggtgccgacttacctgatgacgctggccaaactgccggttaccgccaacggcaagctcgatcgcaaagccttgccgcaaccggatgccgctccgcaacaagcgttcgtcgcgccgcaggatgcgctgcaaaaagcgttggcggcgatctgggaagacgtgctcggccttgagcgcgtcggtctggaagacaacttcttcgaactgggcggcgattcgatcatttcgattcaagtggtcagccgtgcgcgacaggccgggattcgtctcagcccgcgtgacctgttccagtaccaaacggtgcgcagccttgcgctggtcgccacgctggataatcagacctcggtggatcaagggccggtgaccggcgctgccgtgctcgggccgatccagcagcatttcttcagtcgtgtgatgccgctgcgtgaacactggaaccagtcgctgctgctgaccccgcgcgacaccttgaatgcgcagtggcttgatgccgcactaactcagttgatcaatcatcacgacgccttgcgcctgcgctttggcgaaagcgccgacggctggcagcagagccatggcccgctggtgggcagcgctgacctgtggttgcgtgatgccgagtcggcggaacagttgcaggcgttgtgcaacgaagcccaacgcagcctcgacctgcagaagggtccgctgctgcgcgcactgctggtgacgatggctgatggctctcagcgcctggcgttgatcattcaccacttggcagtggacggcgtttcctggcgcgtgctgctggaagatttgcaacaggcttacgagcagcgctcggcgggcggaggcattcagttgccggccaagaccaatgccttccagagctggaccgcgcgtctggaaagcgccgctgcacgcttcgatgaacaactggattactggaaaaaccagcatcagggcgcacaggatctaccgtgcgagcgaccggacggcagcctgcaaaacctgcatggcgagaaaatcgaatggcgcctcgacgccgagcgtacccgtcagttgctgcaacaggcgccggcggcgtatcgcacgcaagtcaatgacttgctgctgaccgcattggcgcgcaccatcagccgctggagccagcagccgggcacgttgatcgagctagaggggcatggtcgcgaagacctcttcgatgacattgacctgacccgcaccgtgggctggttcaccagtctgttcgcggtcaagctgaccgctgccgacgatctcgacggttcgatcaagtcgatcaaagagcaactgcgcgccgtgccggacaagggcctgggctacggcgtgctgcgttatctggcggcgccatcggtgcgcgccgaattggcgcagttggctccgccacggattacctttaactacctcggtcagttcgaccgccagttcgacgaagccgcgttgttcgtaccgtccgccgaaaccagcggtgtcgcgcaggatccggccgcgcctctggccaattggctgaccgtggaaggtcaggtctatggcggtgaattgtcgatgagctggggcttcagccgcgagatgttcgacagcgcgaccgtgcagtatctggtcgaacagtacgccatcgagctgcatgcgctgatcgaacattgctgcacgttgcaagccgcgcaagcaacgccgtcggacttcccgctggcgcgcgtgacccaggcacaactggatgcgctgccggtgccggcgggtcaactcgacgatgtctatccgctgtcgccgatgcaacagggcttgctgttccacaccctttacgaacaagcggcgggtgagtacatcaaccagttgcgcgtcgacgtcgaggggctcgatcccgagcggttccgcgccgcgtggcaggccaccgtcgatgcgcaggacattctgcgcagcgggttcgtctggcagggcgagttggcgcagccgctgcagatcgtccacaaacaggtgcaactgccgttcagcacgctggactggcgcgaccgcgacgatcagcccgcagcgctcgcggcgttggccgatgccgagcgccagcaaggttttgatctgagctgcgcgccactgctgcgactgctgctggtgcagaccggcgccgaacgatggcatttgatttacacccatcaccacatcctcatggacggctggagcaactcgcagttgctcggcgaagtcttgcagcgttacagcggccgcgcgccgatgagcggcggcgggcgttatcgcgactacatcgcctggctgcaacgtcaggacggccaattgagtgaggatttctggaacggccaattagctgccctgcaagagccgacccgactggcgcgcgcggccaccgctggcgagaagcagagcggccacggcgatcactttctgacgctggacgtgcaacgcacccaggcgctggaaacctttgcccgccagcaaaaagtcaccgtcaacaccttggtgcaagcggcgtggctgctgttgctgcaacgctacaccggtcacgaagccgtggcgttcggtgcgaccgtggccgggcgtccggcggatctgccgggcatcgagcagcaggtcggtctgttcatcaacaccttgccggtgatcggcgcgccgcgtccggatcaaagcgttggcagctggttgcaagccgttcaggcgcaaaacctcagcttgcgcgacttcgaacacacgccgctggcggacatccagcgttgggccgggcagggcggtgaagcactgttcgacaatattctggtgttcgaaaactacccgattgcccaggcgctgagtcaggccgggcaagggctgacattcggtgatgtcggcaatctcgaacaaacccattacgcgctgagcgtggcggtcaccctcggtcagcagttggcgttgcactacagctttgatcgcggccagttcgccagcgatgtcatcgccggtatcagtgcgcacctgttgcaattgcttgagcagttcgccgtgtccgccgaacgcaacctcggtgaaatcgccttggccgatgctcaagagcaggcccgccagcaagccgaaaaccatccgcagccgtacccggtggacatcggcgtacatcagcgtattgccgcgttggccacggaaaatccgcagcgcacggcggtgatcttcaacggtgagcatttcagctacggcgagatcgaccagcgtgccaatcaactggcgcacgcactgatcgcccgtggcgtcggcgcagaaacccgcgtcggtgtagctctgccgcgcagcgagtcggtgatcgtcgcgctgctggcggtgctcaaggctggcggtgcttatgtgccgctggacaccagctatccgcgcgaacgcctggcctatctgatcgaagattccgggctggcgctgctgatcagcgactcgtcggtgtcggcgcaattaccggtcgacgaatcggtgccgctgctggaactggatcgtctcgatttgcgcgagttgccgatcaaggtaccgctcgtgcagctcgatccgcacaacctcgcctacgtgatttatacctccggttccaccggcaatccgaaaggcgtcagcgtcgcccacggtccgttggccatgcattgccaggccatcggtcagcgttatgaaatgcgcgacagtgactgcgaattccacttcatgtcgttcgccttcgatggtgcccacgaacgctggctgaccagcctgactcacggtgcgtcgctgctgattcgcgacgacacgctgtggacgccggagcagacctacaacgcgatgatcgaacacggcgtgaccgtggtcgcattcccgccggtgtacctgcaacaattggccgaacacgccgagcgcgtcggcaatccgccgaaggtgcgtatctattgcttcggcggtgacgcggtgccgaacgcgagttttgagcgggtcaaacgcgcgctcgatccggactacatcatcaacggctacggtcctaccgaaaccgtggtcactccactgatctggaaggccggtcgcgaagtgccgtgtggcgccgcgtacgcgccaatcggcagccgtatcggtgaccgcagcgcctacgtgctcgacgccgatctgaacctgctaccgcaaggcatggccggtgagttgtacctcggtggcacggggctggcgcggggttatctgaaccgtccggggctgactgccgagcgcttcgtcgcggacccgttcagcaccaccggcggcttgctttatcgcacaggcgacctggtgcgtcagcgtctcgatggcacgttcgactatctggatcgcattgacaatcaggtgaaaattcgcggtttccgtatcgagttgggcgaagtcgaagcggctctgcaagccctcgacggcgtgcgtgaagcggtggtcgtcgcgcaggaaggcagcgccggcagtggcaagcgtctggtggcgtatgtggtgggcgattccagccgtgccgacttcaccgacgatctgcgtgcgcaactcaaggcgacgttgccggggcacatggtgccggcgtatgtcttgcgtctggagcgcatgccgctgacgccgaacggcaaactcgatcgcaagaacctgccgaaaccggacgtcagccagctgcagcaggcttaccttgcaccgcacacgccgctggaacagcaactggcggcgatctggcaagacgtgctcaagcttgagcaagtgggtatcagcgacaacttcttcgagctgggcggcgattcgatcatctcgattcaagtggtcagccgtgcgcggcaggccgggattcgcttcacaccgaaagacctcttccagcaccagaccattgcagcgctggccgtggtcgcgcagaccggtgaagcgttgcaattgatcgatcagcaaccggtcgccggtagcacagcgctgttgccgatccatcaggagttcttcgcgcaggcgattcccgaccgtcatcactggaaccagtcggtgatgctcaagccgacgcaggcgctgaatgcgcaattgctggaacaagcactcgatgccttggtgctgcatcacgacagcttgcgtctggactttgtcgagcaggctgatggttgggccgcgcaataccgtgatgtggtaacgcaagcgggtgagaccattctgtggcaagtcgaggtcgctgaccttgcagctctggaagtgctgggcgacaaggcgcaacgtagcctgcaactgagcggtggctcgctgattcgcgcggtgttggcgaatctggctgacggtacgcaacgcctgttgctgatcgttcatcacctggtggtcgatggcgtgtcgtggcggatcctgttcgaagacctgcaaaacgcttatcggcagctcagtgccggtgcatccgtgcaattgccggccaagaccagcgcagtcaaagcctgggcggcagcgttgcaggattatgcggcaagccctgcgttgcaggctgaactgcgcttctggcagcagcagttgcaaggcgcttcggccgccttgccttacgaccatccgcacggcgggcagcaacacgatcaggcgctgacgatccgcagcaaactggacaaagccctgacccgtcaactcttgcaggacgcgccacaggcctatcgtacgcaggtcaacgatctgctcctgaccgcactggcgcgagtgatggtgcgctggaccggtgacgacagtgcgctggtcttgctcgagggccacggtcgcgaagacctcttcgacagcatcgacctgacccgcacggtcggttggttcaccagtgtgttcccggcgtgtctgtcaccggtgactgaactgggtgcatcgctcaaacaagtgaaggagcaactgcgggccattccgcacaaaggcatcggcttcggtgcgctggcgcatctgggtgatgaacaggcgcgcgaaaccctgcaggccttgccggcaccgcgcctgactttcaactatctgggccagttcgacggcagcttcgacgcggccgacgaggccttgtttgtaccgaccagcgaagccggcggtgccgaagtcaatatgcaagggccgctgggcaatccgctggcgctgaacggcaaagtcttcggcggcgagctggacctgagctggacctacagcggcgccatgttcgacgccgcgaccatccagcgcctggccgatgactacatgcaggagctgaccgcgctgatcggccattgctgcgacagcggcaaccgtggcgtgacaccgtcggacttcccgctggcgcaactgtcgcagccgcaactggatgcgctggtgctggagccgcaaggcatcgatgacatctacccgttgtcgcccatgcagcagggcatgctgttccacaccttgctcgaacatggcaatggcgactacatcaaccagatgcgcctcgacgtcgatggcgtcgacccgcagcgcttccacgctgcgtggcaagcggtggtggatgcccacgacattctgcgtaccgggttcttctggcagggtgacctgccgcagccggtgcaagtggtgcaacgccaggtcgaggtgccgttcagcgtgctcgactggcacggcaagaccgatctcgacacggcgctgcaaaccctcgctgacgaggagcgcgcactgggcctggacctgacctgtgcgccgctgctgcgtctggtgctggtgcgcacggcgactgatcgtcatcacctgatctacaccaaccatcacattttgatggacggctggagcagcgcgcagttgcttggtgaagtgttgcagcattatcgcggcgaagcggtgccgcgtccggcgggtcgctatcgcgattacatcggctggttgcagcgtcaggatgcggcggctgccgagaattactggctggcaacgctggaacacctgcaagagccgacgcgtctggccaacgccatcgcgcggccagtcgacgctttgccaagtgtcggttatggcgaccattaccaagtgctggacgctgacctgagcgtgcgtctgggtgaatttgcccgggcctcgaaagtcaccgtcaacacgttggtgcaagccgcgtggctgttgctgttgcagcgttacaccggcaaagactgtgtggcgttcggtgcgaccgtggccgggcgtccggcggatctgccgggagccgaagaacagatcggtctgttcatcaacaccttgcctgtggtggccgcgccgcaaacgcagcagagtctggccagttggctgcaagccgtgcaggcgcagaacctcgcttcgcgcgagttcgaacacacgccgctggcggacattcagcgctgggccgggcagggcggtgacgcactgttcgacagcctgatggtgttcgagaactatccgattggcgaagcgcttgaacggggcgcgccgcaggggttgcgtttcggtgcggtggtcaatcaggaacagaccaactatccgctgacgctgctggtgagcatgggcgcgcaactgtcggtgcatttcagctatcagcgcgacagttttgcggcggcgagtgtcacgcagttggctgaaagcctgcagcgtctgctcgggcagatggccgaagcgggtgaaggctcgctgagcgacttgagcctgatcgacagcgtcacgaacgtcgagcccgacttcgtcagcgaactgtgcattcatcaaggcattgcccgccaagtggcggccacgccggatgcgctggcggtgaccttcgccgataggcgactgacctacgccgaactcgatgcgcaagccaaccgtctggcgcacaagctgatcgagttgggtgtcggcccggaagtgcgcgtgggtgtggcgatgccgcgttccgaacagctgctgattgccttgctggcggtgctcaaatccggcggcgcgtatgtgccgctggacccggattacccggctgatcgcgttgcctacatgctcgaagacagccttgcgcgggtgctgctcaccgagcaagcggtcgccgcaacccttagcgtaccgagcgatacccaagtgctgctgatggatcaggtttcgctgaccggttattcaggtgtcgccccgcaaacgtcggtgcagccggacaacctcgcctacgtgatctacacctccggttccaccggcaagccgaaaggcgtggcgattgctcaccgcaacgtaatggcgctgatcgactggtcggcgaaggtttacagccgcgacgatattcaaggcgtgctggcctcgacatcggtgtgcttcgacctgtcggtgtgggagctgttcgtcacgctggccaatggcggatcgctgatcatcgcgcgcaatgcactggaactaccgaccctgccagctcgcgatcaggttcgcttgatcaacaccgtgccgtcggccatcgctgcgctgcaacgcgccgggcagattcccgcgagcgtgcgcatcatcaacctcgcgggtgagccgctcaaacaagggctggtcgacgcgttgtatcagcagtcgacggtcgagcacgtctacgacctctatggcccgtcggaagacaccacctattcgacctggacccgccgtatcgccggcggtcagccgcgcatcggtcgtgcgctcgatcacagcgccagccatttgctcgacgccgatctgcaagcggtgccgcatggggtttcggccgagctgtacctgtccggcgccggcatcacccgcggttatctggggcgtgcggcgatgaccgccgagcgctttgtaccgaacccgttcgtcggcaatggcgagcgcatgtaccgcaccggcgacctgattcgtgaacgcgaagagggcgaactggagtacatgggccggatcgaccatcaggtgaaaattcgtggattccgcatcgaactgggggagatcgaggcgcgattgctcgctcaacaggacgtcagcgaagcagcggtgctggccatcgaaagcgaaaccggtgcgcaactggtggcctatgtggtcgccccgcagctggacatgcatgacggcgaagcgcagcggcaactgcgcgacggactaaagactggcctcaagtcttcgttacctgactacatgattcccgcgcacctgctgttccttgagcagttgccactgacccccaacggcaaactcgaccgcaaggccctgcctgcggtggatgccagccagatgcaggccgcatacgtcgcgccgcagagtgagcttgagcagcaggtcgcggcgatctggcagcaagtgctcgaggttgaacgcattggtctgaacgaccacttcttcgaactgggcgggcactcgctgctggcggtcaacgtggtgtcgcgcatcgccctcgaactgggcctgacgctgaccccgcaactgttattccagcaccccgtcctgagcgactttgtcgctcgactcgatacaggaggcggggcaatcaacgaacagaaactgagcaagctggaagccctgcttgacgatatggaggaagtctgatggacaagagtgttgctttgagggtagccaagcgctttatcactctgccgctggacaaacgtaagctgtacctggaaaagatgctcgaagagggcgtctctccggccaacctgccgatcccggaaacacgctccgggtttgtcgccattcctctgtcgtacgctcaggaacgccaactgttcctctggcaaatggacccgcacagcaccgcgtatcacattcccagcgccttgcgtctcaagggccagctggacgtggcggcgctggaacgcagcttcaatgccgtggccgcgcgccacgaaagtttgcgcaccacgtttgccgagcacggcgaaaccttctgccaagtgattcacccgcaattgccactgagcatcaccctgacaccgctgccggcaggcctcgacagcgttggcgaagaggcggcgatcaaggcgtttgtcgaaagcgaaaccgcgcgcccgttcaatctgcaacagggtccgctgctgcgcgtggcattgctcaaggtcgctgatgacgatcatgtgctggtgttgatccagcaccacatcatcgccgatggctggtcgatcaaagtgctggtcaacgagctgatccagcattacgccgccgacagcgccgggcagccgttgagcctgccggaactggaggtgcaatacgccgactatgcgatctggcagcgccattggctggaagcgggcgagcgtgagcgacaactggcttactggatcaagacactggacggcgagcagccggtgctggaactgccgatcgatttcccgcgtccggcagtgcaaagtttgcgcggtgcacgcctgcaactggacctgccggcggccctcggcgatgcgctcaagcaactggcccagcgcgaaggcgcgagcctgttcatgctgttgctggcgtcgttccaggcgttgctgcatcgctacagcggccaggcgcagatccgtgtcggcgtgcccacggccaaccgtaaccgggtcgagaccgagggcctgatcggcttcttcgtcaacactcaagtcttgaatgccgaagtgcatgggcaactgccgttcaaccaattgctggcccaggtcaagcaggcggcgatggccgcccaggcacatcaggatctgccgttcgagcagttgatcgaagcgctgcaaccggaacgcagcctgagccacagcccggtgttccaggtgatgttcaaccaccagaccagccgtgatcagggccgtggcgcggtgcaactgccgcaactgagcgtcgaggatgtgcagtgggaagggcgcaccgcgcaattcgacctgacgctcaatacctatgaatcgaatgacggtttcgccgccgagctgacctacgccaccgatctgttcaagccggaaacggtcgagcgtctggcgcgtcattggcaaaacctgctgcaaggaattgtggccgcaccgactcaacgggttggcgagttgcccttgctggaaagtgccgagcacggcgttctgttgcaggactggttccgcgtggcggatcacagcgcgcagggcgaatgcgtgcagcaggactttgccttgcaggcgcagcaaaacccgcaggccacggcactgatcatcggcgacgacgtactgacgtatggcgaactggatgcccgggccaatcaactggcgcatcacctgatcgaggccggcgtcggcccggatcaactggtcggcatcgcggtcgagcgcagcgttgagatgatcgtcggcctgttggcgatcctcaaggccggcggcgcttatgtgccgctggacccggcgtatcccgaggatcgcctggcctacatgatcgaagacagcggcctgcaattgctgctgacccaaacgcatttgcaagcgcagttgccgatcccggcgggtgtgcaaaccctgttgctcgatcagccagctgcctggctggcggcttatccacagaccgcaccggacgtggccgtcaatggcgagcatctggcctacacgatctacacctccggctctaccggcaaaccgaaaggcgtgatggtgcgccacgcggcgctgagcaactttgtcgcgagcatgatcaaccagccggggattgccgctgcggatcgcatgctgtcgctgaccacgttctcgttcgatatttttggcctggaaatctatggcccgctgctggctggcgcctgtgtggtgctgaccggcaaggatgtgcatcaagacccgcaagcggtgctcgaactgatcgagcgtcatgccgtcagcgtcctgcaagcaacgccatcgacctggcgcatgctgctcgacaacgaacacgcagcgattctcaagggtcgcacattcctctgtggcggtgaagcgctgccgcaggaactggcccagcgcatgctggcgctgacgccgagcgtgtggaacctgtatggcccgaccgaaaccacgatctggtcggcgcaacatgcgctgagtgcggacaacagccgcccgtttctcggtacgccgatcgacaacactgcgctgtacatcctcggcagcgaccttgagctcaatccgctcggcgcacccggtgaattgctgattggcggtgacggtctggcgcgcggttactttcagcgcccgagcctgaccgccgaacgttttgtgccggatccgttctcggcaaacggtgcgcgtctgtaccgcaccggcgacctgacccgttatcgcgcagaaggcgtgatcgagtacatcgggcgcatcgaccatcaagtcaaaatccgtggtttccgtatcgaactcggtgagatcgaagcgcgtttgctcgcgctcgacagcgtgcgcgaaaccgtggtggtcgcgcaggacggcccgactggaccgcaactggtcggctatgtggtgccatcctccagcgctgttgatgaagtcgaactgcgcgctgaattgaaagccagcctcaaggccgagctgccggaatacatggtgccggcgcacctgttgttcctcgcgcaactgccgctgacccccaacggcaaagtcgaccgcaaagccttgccggcgccagatgccagtctgttgcaatcgacttacagcgcgccaaaaaccgcgactcaacatgccgtcgccgagatctggcaagcggtgctcaagcttgagcgtgtcggcctcagtgacaacttcttcgaactcggcggccattccttgctggtgacgcaagtggtctcccgtgtgcgtcaggccctgaacgttcaggtgccgctgcgcacgctgttcgagcacagcacgctggaagatttcgttgctgctttgggtgtcgatcaggcgactcaggaaccagcgattgttgcgctgccgcgtctgcaaccgttggcgctttcctatgcgcaggagcgtcagtggttcctctggcagctggaaccgaccagcaccgcctatcacgttccggcggcactgcgtctgcgcggtgagctgaatctgccggcattgcagcaaagcttcaatgcattgatcgagcgccacgaatccttgcgcacctgcttcgtcgaacagcagggccagacactgcaagtgattcaggcgcatggcacgctggatctgcaagtgcaggacgtggcggggctcgacgacgcggcgctgcaagcgctggtcgccgcagaaaccctgcacctgttcaacctgcagcaaggcccgctgctgcgggtgaaactgctgcgtctggccgccgatgatcacgcgctggtgatcaccttgcaccacatcgtctccgacggttggtcgatgaacatcatggtcgatgaactggtggcgctctatgccgcgtactgccagggccagaccgcgccattgccggcgttgccggtgcaatatgccgactacgctgtgtggcagaaacagtggatggacgccggtgagcgcgaacgtcagctgaattactggaccgcgcaactcggcgatggcgatcaaccgctgctggaactgccgaccgaccgtccgcgcccggccgagcaaagctatcgcggcgcgcgtcgcgacatccccctgagcctcgaactggccactgccctcaagcaagtcgcgcagcgtgaaaacgtcaccctgttcgcgctgttgctggcctcgttccagaccttgctgcaccgctacagcggtcaggccgacatccgcgttggcgtgccggtggccaaccgtaaccgggtggaaaccgaaggcctgatcggcttcttcgtcaacacccaggtactcaaaaccgaattcgacagccagcagacgttccgcagcctgttgcaacaagtgaagaacaccgtgctcggcgctcaggcccatcaggatctgccgttcgagcaactggtcgacgcactgcaaccggaacgcagcctcagccacagcccgctgttccaggtgatgcacaaccaccagagccaggcgcgtcaggcgcagggcgcgacacgcctgccgcaactgcagatcgaaggcttgccgtgggcatcgaatacggcgcagttcgacctgaccctgaacacctttgaatcgaccgacaacgtctgggccgagctgacttacgccaccgacctgttcgacgtcgagaccatcgagcgcctgtcgcgacactggacgaatctgctgcaaggcatcgtcaccgacagcggccagcgtatcgctgagctgccgctgcacgacgccgccgaacgcgcagcaaccctgctgcaatggaacccggccgtggccgatttccctaacgagcagtgcctgcatcacttgatcgaagcccaggccgcccgcgcaccgcaagcggtagccgtgacgtatgccgagcagtccttgagctactttgagctcaacagccgcgccaaccagttggcgcacaagctgattgccagcggcgtcggcccggacgtgcgcgtgggtctggcggtggagcgcagcctcgacatgctggtcggcttgctggcgattctcaaggctggcggtgcgtatgtgccgctcgacccaagctacccggaagagcgtctgagctacatgatcggcgacagcggcatcggcctgctgttgacccaaagccatctgctcggccgactgcccgtaccggactcggtgcgcagcctgatgctcgatcaggatcgtgaagacctcgaaggctacagcgactgcaacccgcaggtgcagatgagcgcggacaacctcgcgtatgtgatctacacctccggctcgaccggccagcccaagggcaccttgctcgcgcaccgcaacgtgctgcgcctgttcgaagccactgcggcgtggttcgatttcggcgcgcgggatgtctggagcctgttccattcctacgcgttcgacttctccgtgtgggagattttcggtgcgctgctgtacggcggcaaactggtggtggtgccttacgaggtcagccgtgcgccggaagatttcttcgctttgctctgtcgcgaaggcatcaccgtgctcaaccagacgccgtcggcgttcaagcaactgatgcaagtcgcctgcgccccggaacacgccgcgcaacaactggcgctgcgttacgtggtgttcggcggtgaggcgctggaagtgaaaagcctgcgtccatggttcgagcgtttcggcgatcaaacgccgcaactgatcaacatgtacggcatcactgaaaccaccgtgcacgtgacataccggccgttgtcgatggccgatttgcagcgtgacgccagcagcccgatcggcgagccgattgccgacctgtcgtggtacttgctcgacggcgatctgaacccggtagccaaaggttgcatcggtgagctgtacgtcggtcgcgccggcctggcgcgcggttatctgaatcgtgccgatctgaccacgctacgcttcattcctgatccattcgccactgacggtggtcgtctgtaccgcaccggcgacctggcgcgttatcgcgctgacggcgtgatcgaatacatcgggcggatcgaccatcaggtgaagattcgcggtttccgtatcgaactcggtgagatcgaagcgcaactgctcgaacaggctgccgtgcgtcaggcggtggtgctggcgcagccgggcctcagcggtcagcaactggttgcgtatctggtgccgactgatgcggcattgctcgacgccagcgccgctgaacaagcgcaatggcgcgaccgcgtgcgtgccgaactcaaggaaaacctgccggatcacatgatcccggcgcacttgttgctgctcgggcaactgccgctgaccgccaacggcaagctcaaccgcagcgcgttgccgtcgccggatgccagtcaggcgcagcagacttatcaggcgccgcaaagcgagctggaacaacgcttggcggtaatctggcaagacgtgctgaagctgtcgcaagtgggtctcaacgacaacttcttcgaactgggcggcgattcgatcatctcaattcaagtggtcagccgcgcgcgacaggccggtattcgcttgaacccgaaagacctgttccagcaccagaccattcaacgtctggccctggtcgcgcagttgggcgatgacgatacgagcatcgaccaacaagcggtcaccggcgcagcgttgctgttgccgatccagcagcagttcttcgacgatgaaatccctgagcgtcatcactggaaccaatcggtgctgctcaagccgcgccagccgctggacgcggaaaaagtcgagcaagtgttgcgtgcgctggttgcccatcacgatgccttgcgcctgagtttcacccagcacaacggcgtgtggcaggccgagcaccgcgcggttgaagatcaaccgcaaaacctgctgtggcaggaagccgtcgccgatgccgacgcactggaggccttgggcaaccgcgcgcagcgcagcctcgatttgcagaacgggccgctgttgcgtgcggtgctggcgaatctggccgatggcacccagcgtttgcagttggtcattcatcacttggtggtggacggcgtgtcgtggcggattctgctggaagacctgcaaaacgcctatcagcaattgctcgacggtcagccactgaagctgccggcgaaaaccagcgccttcaaggactggagcgagcacttgcagcgctacgccaacagcgcggcgttgcaacaggaactggcttactggcaggcctgcctgagcgatgtcagcaccgatctgccgtgcaagcgtgccgatgccggtcagcacaatcgtctggcgcacactgtgcagacccgtctcggcagcgagctgacccgacagttgctgcaagaagccccggcggcgtatcgcacccaggtcaacgacttgctgctgacggcgttggcgcgggtcattggccgctggagcgggcaggcgtcgacgctgattcagctcgaaggccatggtcgtgaagagctgttcgacggtgttgacctgacccgcaccgtgggctggttcaccagcctgttcccggtgcgcctgaccccgacggtggcgccgggcgagtcgatcaaacagatcaaggaacaactgcgctcgatccccaataagggcatcggtttcggtgcactgcgtcatcttggcgatgctcaggcacaacagagcctgcgtgaattgccgaccccgcgcatcaccttcaactacctcggtcagttcgacggcagtttcgagggcgatgacggcgcgctgtttgcaccggcgccggacaatgccggtctcgaccagagcccggacgcgccaatgggcaattggctgaccctcaacggtcaggtgtacggcggcgaattgcgcgtaggctggaccttcagcagcgagcgtttcgacagtgctgtgatcgaagcactggcggcggattacgccgaggagctggccactttgatcggccattgcctgaccccgggcgtcgctgggctgacgccttcggacttcccgctggccgggctgacccaggcacagctcgacggcttgccaacccgtccacagcagattgacgacatctatccgttgtcgccgatgcagcagggcatgttgttccacaccctctacgcgcaacagtccggcgactacatcaaccagatgtgtgtggccgtcgatggcttgcaggtcgagcgtttccgcgatgcctggcaagcggcgatggacagccacgaagtgctgcgcagcggttttgtctgggaaggtgacctgcccaatgccctgcaagtggtgcacaaaggcttgcaagtgccgttcagcgtgctcgactggcgtgatcgcagcgaccaggcgcaagcgctgaaagccttggaacttgaacaacgccagcaagggtttgatctgcacgcggcaccgttactgcgtctggtcgtggtgcaggtggcggctgagcgcttccatctgatttacacctcgcaccacattctgatggacggctggagcaactcgcagttgctcggcgatgtattgcagcgctatcacggccacgcgccggcgatgggggcgggacgttatcgcgattacatcgagtggttggcgcagcaggatgcgcaggtcacggaaaacttctggaagggccaactggccgacttcgagacaccgacgtatctggccgatgccgtgccgcacctcgttgatgcaagcgtcagcggtcagggtgaatacctgctgaccctcgacactcacgcgaccgctgaactcaacagttttgcccgggcacaaaaagtcacggtcaacacgttggtgcaagccgcgtggttgttgctgttgcagcgctacaccgggcaggacacggtcacgttcggcgccacggtatcggggcgaccggcgcagttgaacggcgtcgaaggtcagatcggtctgttcatcaataccttgccgatcattgccagcccacgtgccgaacagtcgttgccgcaatggctgcaacaggtgcaggcacagaacctgctgctgcgcgagcaggaacatacgccgctgttcgacattcagcgttgggcggggcagagcggtgaggcgttgttcgacaacattctggtgttcgagaactacccgattgccgaagccttgcaacaagccgaatcggcggatctgcgctttggcgaagtcgaccgttatgagcagaccaactatccgctgacgttgatggtcaacctcgatcagcaattgaccgtgcacttcagctatcaacagacaagttttgccgccggcaccgtggtcaaactggcaacgcagttgcagcaactgttgagcggcatgcgcgccagtgtcgatggctgtctgggcgaatggaacctgcttgaagcagacgatgagcagcgcatcctgcgtgactggaatccgcaggcaaccgctgaccttgagccgatttgcattcaccaggccatcgagcgtcaggtcgctgcccagccgaacgcgcgcgccgtgacgttcggccagcaatccttcacctatggcgatatcgatgcccgggccaatcgcctggcgcaccgtttgatcagcactggcgtcgccgccgaagtgcgcgtcggtgtggcgatgcagcgctctgacaacctgctggtggcattgctcgcggtcctcaaggctggtggtacctacgtgccgctggacccggattacccggcggatcgggtcgcctacatgcttgaagacagccgcgcccgcgtgctgctgaccgagaccgatgtggcggccaccctgtcgctcgccagcgacatgcaagtgttgctgctggatcaactggatctctcggcctacagcacggtcgcgcctgtcaccgacgtgagtgtgaaaaatcttgcctacgtgatttacacctctggttccaccggcaagcccaaaggcgtatcgatcagccatgccaacatcatggcgctgagcgactggtcgaagcatctctacagccgcgaggacattcaaggtgtgctcgcttcgacgtcggtgtgtttcgacctgtcggtgtgggagctgtttgtcaccctggccaatggcggttcgttgatcatcgcgcgcaacgcgctggagttgccgaacttgccggcgcgcgatcaggtgcgtctgatcaataccgtgccgtcggcaatcaatgccttgcaggacgccggcgatattccggccagcgtacgcatcatcaacctgtgcggcgaggcgctgaagcagaacctggtggacaccctgtatcaacaggcgaccatcgccgatattttcgacttgtacggcccgtcggaagataccgtttactccacctggacccgtcgagaggctggcggcacggcgaacatcggtcgaccgatgatccgcaccgccagttatgtgctgggcggcgatctgcaaccggcaccacagggtgtgtcggcggagttgtacctggccggtgccggtctcagccgtggctatctgggccgggcggcgatgaccgcagagaaattcgtaccgaaccctttcgccggcaatggcgagcgtatgtaccgcaccggcgacctgacccgttatctgggcgacggcacgttgcaatacgtcgggcgtatcgatcatcaggtgaaggtgcgcggtttccgtatcgagctgggcgaaatcgaagcgcgtctgttgcagatcgacaacgtcagccaagcactggtggtggcgcaaccgatcgcctccagccatcaactggtggcgtatgtggtggtcgatgacgcgaccgtggccagctccgatgcagccgcgcaagcggtgctgcgcgaagcgctgaagacgcgactcaaggtgcacttgccggactacatgattccggcgcacgtgctgttcctcgccagcctgccgctgacgccgaatggcaaggtcgaccgcaaagccttgccgagcatcgacgcgtttgtcgcggcgggtgacttcgttgcccccgtcggtgaactggaacagcagatcgcagccatctggcaaaacgtcctggaactcgatcaggtcagccgcgaggatcatttcttcgaactgggcgggcactcgctgctggccactcaggcagtttcgcgtttgcgccatttgaccggcggcacgttgagcctgcgggacctgttcaactatccgcgcctcaaggatctggccacctggatggccgaagaacaaacaccggcccttggcggggcggccagtcaggccgttccactgaaggcctggggcagcaaatcgacggcaccgctgtcgctggtgcaacggcgtttgtgggtcgccgagcaattgtccggcggcagttcggcctacggcatgccgctggccctgcgcttgcgcggtgagctgtcggtcgagcgcttcatgagcagttttgccgaagtggtgcgccgtcatgaagtgctgcgcaccgcgtactcgcaggatgacgaaggtgatccgattgcgctgattgccgagacggtcgatgtcgacttcccgttgctcgatttgtccggtctgtcgcgcagtgcccaggaagaacaggtcgcgcaggctgcgctggataacgcgcgaacgccgatcgatctggagcaggcgccattgtggcgcgggcgcattctgcatctgtcaccgaccgagcatgtgctgctgttctccatgcatcacatcatttctgacggttggtcgatgggcgtattgatcaacgaactggtgcagctctatgagctgagcaaggccggtgctgccgcgtcgttgccggcgctggaagtgcagtactcggactttgccctgtggcaacaggagctggaacggcaagggattcttggccagcaggcggattactggagagagatgctcagtggttacagcgggcagctcaacctgccgctggacaccccgcgagggccggtggcgtcgtacgacggtgatgccgtgcagttccatctgccgaaggatttgagtcaggccttgcgcaaggttgccaatgacgccggggtgacgctgtacagcacgctgctggcgtcgttccaggtgttgttgcatcaattcagcggcggcgacgacgtgttggtcggcgccgacgtcgctggacgcgagcaggcgcagctggaacaactgatcggcttcttcgtcaacgtcttgccgctgcgttcacgcttctcggccgacacggcgttctcggcattcctcgcccgtacgcaggacatcctgctcggcgcgctggagcatcaggacctgccgctggacatgatcgtcgaatcctgtggcgtgccgcgccacaagggcatgaacccgttggtgcaggtgttgttcgtgatgaacaacctgccaggccgtacccaatccatgggcggtttgagcgtcgagccgctggcggcgctgcagagccattctaaattcgacatggcattgttcgttgacgaagaagaagggcaattgctgggtaattggcaattcgccacaaccttgttcggacacgagcgcattcagtacctggtgcaggcctggatagccctgttggaacagatcgtcgctgatcaggacattcaattgggagctatcagcatgccagtcgacaatttagcagtggccgccaaacccgctgcccccggacccaaggccgacaaactgggcaagttcctcaagcgtggcgccgcgccggtggccaaggttcgcccggcgccgatccgcgaatcgctgatcgccgcgccgcagccgttcccgctgttgatggaaccgaacgagccgcagctggatttgatcgagtggatcaagcacaaccgcccgctgatcgaagaaaaactcgcgacccacgccggcattctcttccgtggtttcgagctcgacggcattcagggctttgaggcgttcgccgaagcgatccagccaggcctgtacggtcaatacggcgatctgccgaagaaggagggcggcaagaacacttatcgctccacgccgtacccggaacgcaagatgatcctgttccacaacgagagctcgcaccaggatcgctggccgcgcaagcagatgttctattgcgagcaagcggcgccggtcggtggtgcgacgccggtggtggattgccgcttgatgtacgaaaaactgccggcggatctgcgtgacaagttcgagtccaaaggcttgctgtatgtgcgcaccttcaccgacaacctcgacgtgtcgtggcagcacttcttcaagaccgaagaccgtgccgaagtcgaagcccgctgccgcgccggcggtatcgagtggcgctggctcgacaacaacgaactgcaaacccgcacaccgggaccggcgatcattcgtcacccgatcaccggcgccaagtcattcttcaatcaggtgcagttgcaccacatctactggctggagccggatgtgcgtgaagacctgttgtcgatgttcggcgccgagcgcatgccgcgtcacgtgtactacggcgacggttcgccgatcgaagacgacgtgatgcaacgcatcggtgagctgtatgaagagtgcgccgtgcggttcgactggcagaagggcgacgcgatcctgctcgataacatgctggtggcgcatgcccgtgatcccttcgaaggtccgcgcaagattgtcgtggcgatgggtgacatgtatgaccacggcagcctggagcgcccgacagccgccgctcaggtggcaatgaatactgaggaaagcggagcatgagcgaagtcatgatggacgtgcaggatccgggtttcgccctgacgcctgagcaacaggcgctgcttgagcgcctgtcgaacaccgccacctgtggcgaggccatgcgctggctcagcgttgtcattgacggtgatctcgacccgcaacgtttgcaggccgcgttcgatagcgtgctgacacagcagccgatgttgttggcgcggctgggcaaggctgccggttttcacggtttgcgtcaggcggcgaccggcagcgtgcgcttcccgctgacggtccatgccggcgagcagcgcgccgaggatgtccaggcgcagatcagcgaatcactgggtcgcgcctttgtcgtcggcgagtcggccagcgtgcaggcggtgctttatcgtctggcgtcgcagcaatggcaactggtgctgggcattgctcgctacagcgccgacgcgccatcgttgaaccttgtgctgcaacaagtgcaacaggcgtacgccggggttcagccaaccgaagacgaggagtcgggggaattcgcccagtatctggaatggcgcagcgaagtggtgctcgatgaagatgccgccaccgctcgagcgtactggcagcaacacctgcaaggtgtgcagacggacatcgcaacgccttggctggctgctcgcagcgccagcctcgaagcgagtgctgccgattcgcgcgtagcgctgaatctgcaggcggcgcagcgtgatgctctgcaagtgctggccgagcagcttggtcagccagtcgccacgttgctgcaaggcgcgtggtggctgttgctcgggcgtttgagcgggcttgatcagacactggtcggtctgcgccatgacagccgtggcgactacgagtatttcgccaacgccgtgggcgtgttcgagaaaaccttgccgctgtcgctggaattgcctggcagcgcgcgcttcagtgactggctgggacagttggccgcgcgtgtcgaagaacatcgcacctggcaggaatactggacgccggaactggcgcccgaggccgcgcgcccggcttacggctttagccttggccagatcggcgttgccaccaacagcagcggtttgcgctgggtccgggctgaagccgtgcaggtgcaaccggatgctttcgagttgttgttgcaggtgcagctggacgaaaaccagcgtcttgccggcgctggtctgcagtacgccgcttcgcgctattcgccagcggcagccgaggccgtactggatcagttcggcgcactgttgagcgcgattgtcgaggcgccgcacacagcgcttggccaactcaatctgctcagtcacgccgccgaacagcgcctgctggcgatcaacccgccgccgcggatgctggtcgacacccgttacctgccacagcgtatggctgacttggcgacgcatacgccagacgcaatcgccttgaccgatgctgagcagcaattgagctatggccagttgctggatcgtgcagaaaccgtggctcagggcctgagcaacaaaggcgtgggcaaaggctcgatcgtcgcgctggcgctgcctcgctcggcggacctggtcatcgcgatgttggcgagctggcgcatcggcgcggcgtatctgccgctggatgtgcaatggccacaggcgcgtcaggcgttgatgctggaacaggccaacgcagcgctgttgttgaccgatgcagcgcacgtgacggcctggcaggatcagccgcacaccgcgctgaccctggccgacctcggcacgtcgcacgcggtattgccgcggctgtcgaccgagggtagcgacatcgcttatgtgctgtttacctccggctctaccggtgtgccaaaaggcgtggtgatcgagcatcggcacttgctcaattatgtcgcgcaggccagtcaggcgctgggcctggagcagtgcaaaaacatcggcttcagttccaccgtcgcggcagatctgggcaacaccacgttgttcggtgcgttgttcaatggtgcaacgctgcatgtcgccagcgatgcgcaaatgcaggacggcgcgttgttcgccgagtacctgcagcagcgtcagatcgacggcctgaaaatcgtcccctcgcaccttgccgcgctgcttgacaatgagcaggcgagcttgccgcacacgctggtgctgggcggcgagccgattgcgccgacgctgatcgagcgcattgtgcggctgcgcagtgattgccgggtgttcaaccattacggcccgaccgaagccacggtcggcgtgatgattcatccgctgacccttgacggctcgggcggcgattgttcggcgttgagccaggtgctcggcaacaaccaggtgtttgtgctggacgctgatctgcggctggcgccggagggtgtgctgggtgagttgtatctgggcggggcgcaaatatgccgtggctatttgaacgccgaggccgatgcgcagacgttccttcagagcccgttcgatcctgcgcagcgtttgtatcgcagcggcgacctggcctgttaccgcgccgatggtgcaatccagctgcagggtcgacgtgatcagcaggtcaaggtgcgcgggttccgtatcgagctggcggaaatcgaagccgagctgctgcgcttgccagcggttgccgaagcgctggtgctgcctgcggcgtcggccgagcaaggcctgttggcatttatcgtggcgcagcaaggcgttccggcggggctgcttgacagcgctcgtgccgagttgagcacgcgcttgcccgccgtgatggtgccgcagcatttgcaactgatcgaacggtttccgcgtttggccaatggcaagattgatcgcaaagcgctgcaacagttggccggcactgccgccaatgacgaaggtgaggcgccgcgcgatgcgttggagcaattgctcgctgggcgcatggcgcaactgctggggctggagcgtctgggcatcgaccgtgacttctttgccgccggtggccattcgttgctggtgatcaaactggtggccggtattcgcaagttgctgcaatgcgaagtgcatcccgggctggtcttcgatcatccgaccgtggcgtcgttggcgctggcgttgcgggcggtcgaaagcacgccggggcagttggaaaaaatggctcaggtgcgtctgcgtatggatgcaatgagccccgaggaaaaggctcgactggctgaacaagcgcggcagctgcaagccgccaaggctgcgcagacaagctgaaatagcaagaaacacaaggccgtcgcccaacagcgtcggccttttttttaaatttttgcgctaatgataaataaactcattccggttttctggaggtgctgcgtcttactaaggtatgtggacaaagtcggttggcagggcagcctcgcaccggatctgttcagcagaaaaaatttcgccgttgtttcgccagatgatcgtgcccggggaggggccggtcggccacgcactgtcatgttgcccaaggggccatcgacagtgtgcggttctcgagtgcaggcagcggcgggcccgtcggcccaatggactttcacttttaccaataatagagagcacgatgtcagcaattcatgagttgaaacctctgttcaaggcactcgtcatgtcccgcggccttcgttcgcgtcgggtgctgaccggtctggggctggtctgtgtgttgccaatcagcgcccaggtgatggcggaagacgtcagcatcaacattgcggcgcaatcgttgccgcaagcgctgcaagccttcggccaacagaccaaccagcaagtgatctataacgctgacgacatgaccgggctcagaagccacgcggtcagtggcaagatgagcccgcaggcggccatcgccgaattgctcagaggcactggggtgcgctacagcatcgaaggcaacacgctgatgctggtacgtggcagcaacacccagggcctggaactgggcgcgaccaacatcagcgcgcaacaggtcggtgcgaccaccgaaggtagcaactcgtacacctccaacgccgtcaccatcggcaagggcacccacaccctcaaggaaattccgcagtcggtcacggtgatgacccgcaagcaaatggacgaccaggacctggttgacctcaaggacgcgctcaaccagaccactggtgtcgtgggtctgcaaggggtcggcaagggtttgatcatttcctcgcgcggtttccagatcgacgactggcagtacgacggcgtgccgatcccgcgtaacacctattcgctgggtaactgggcgacccaggatctggtctttttcgaccgcctggaaatcctgcgcggtgcctccgggttgctgcaaggcactggcagcccgggtggcgcaatcaacctggtgcgcaagcgcggtcaggcggcaccgactgtaagcgtgaccggcaaggctggctcatgggatcactacggtctgcaagtcgacgcaggcggcccgctgaaccaggccggcaccatccgtggtcgtctggtggccgatcaggaccagagcaattctttcatcgactctgaatggagtcgcaccctgtcgctgtacggctcgctggacttcgacctgagcgaagacaccaccctgggcctggccgtcagccgttccgacggtgattcgcgtccgatgatccgtggtctgccgcgatatgctgacggcaagatgccggacgtctcacgctccacctacaccggcgcgcgctggaacagttcggacatcgacgtcaccacgctgtacgccgatcttgaacatcgcttcaacgaagactgggcattcaaggtcggtgccgtgcgcatgaccgagagcaacaaggcgaagaaccagcgcgtgcaaagtgccggcgatggtctggaagcggatggcagcggcgtgcagtacgctaacttcctgaccgatttcgactccaccaaggtcggcatcgacatgaacctgaatggcaagttcgaagccctgtcgatgcagcaggaagtgatgttgggcggtaacttttcccagctcgaaacggacgaccagctcgcccgtactttcagcaacagcagcgacacgatcttcaacctgaacaaggaccgtaccgacatcagctatgacagcctgatcgctgccaacggtcgtggcacgctgagcaagtatgacgttcgtcagaaaggtgtgtacggcacctggcgtgtcaaaccggtcgacgatctgaccctggtgctgggctcccgtgtcagctggtatgacttcagctacaaatccaaggcgcaatcttccttcggcggcatcaccaagaacgacccaagtaccgcgactgaaaccggggaagtcacgccttacgctggtatcgtctatgacctgagccgcgagtgggcggtttatgccagctacaccgacgtgttccagccgcagaccaaccgcgatgtcaacggcaccgtgctcaaaccggtcatcggcagcaactacgaaatcggtctcaagggcgagttgatggacggccgggtcaacacctcgttggcactcttccgctacgaccaggaaaaccgtgcgatcaacgacattgccggtggtttcgagtgcgatggttcgtactgctcgaccgcttcgggcaaagtgcgcagccagggtatcgacgccgagatcagcggcgaagtggtgcaagacctgcaactgtttgccggctacacctacaacaccaccaagtacatcaaagatcctagcaacgaaggtcgcgtgttcagcacctggacgccaaaacacatgctgcgcatgtgggccaactaccagttgccgggtgagtggaatcgcgtcagcaccggcctgggcttcgtgacccagagccatacgctgggttacgaaggcacctacgatgttgcgggttacaccgtatggaacgcccgcgtcggctaccagctgacacctgaagtcggcctggcgatgaacgccaacaacctgttcgacaagaagtacattgcggccggttacaaccagctcgacggcaacaacaacttcggtgatccgcgtaacgtgatgttctccgtgaagtggacccctcagttctgatgcactgaaggcccttcaccgaagcggcccatgctcctctacagagggcgtgggccgttttttttgcccgtctgcagctgaatcccgcaggttatgcgtcaagtcacgcaaaaaaaaacgcagaagccagcgcttctgcgtttttgttgaccaggatggaaatcagtttttcagtgccgcctcgcacgtcaggaacaccgattcgaaggactccagcaacgactcaccgtaaatcatgctgcggtggggcagggtggaatgcaccgagccttgcagtcgtccgctgacggtgtgttcacgcagcacctgttccgagtgcaacacctgttccaaagtcttgtgcgacagcgaccaccagcaactggcctcgacctttagcgttggcagcgtgaaggcgtcgtaggatttcaccagccgatcatggatctcgaacgcctgggcattcatgatttcctgtttgatggcgtccagtgtcgccaccatttcctgttcgctggtggcagcctgttggctggcccactggtagaaagccttcagatcggtctgcggattctcggcgaggaagcatgccgccgcttcgtgcagatgagcgaacatcagactgaacatttccacagccgtcgccagctcattctgtgcgctgaagtactcgggattttcttcttccagtggtttgcgcggcagatcggccggcaacaggctgtccggcaaggtggtatcgaccagaccgaggaagctcactttacgtccctgacgctccagttccgcagcaatgtccatggcgatggagccgccgagcgaccagcccatcaagcgatacgggccgtccgcctgcttgtcgataatctgccgggtgtagtcggcgatcatctgcgcccaggtctgggcgtgggcgtgtttatcggcgaagcctgtgtgcatcacgccgaaagtgcgcgcgtgtttgctcaggcgtttggccaacggttggtagcagaacacgatgccgccgctgggatgcaggcagaacagcggcggggcgctggtggccgaggccgagagctccaccacgcactgggcttgctgctggtgttgcgtggcaatgaattgcgcaagggtttcgacggtggcgtgggcgagcatttgctgcaaagcgagtttgatccccaggcgcgcattgagtgcggcaataaactggatggccagaatcgaatgcccgcccagttcgaagaagttgtcgtcgaggccgacccggtcaacgtgcagggtttcctgccagagttcggccagcgcttgctccaatgcagtttccggggccttgaagcgggtctccgattgactgatgtcaggcagcggcaacgccttgcgatcaagtttgcctgtcgggctgacgggcatggcttccagcaccagcagatggctcggcaccatgtaggcgggcagacggcttttcagttcagccttgagggctgcgcgcagttgatcgtgctgctcactcgacaaatcactggcgctcggcacgacataaccgatcaactgcatcccggccaatccttcgcgagcaaggaccagggcttcgcgaacagccgggatttgcagcaggcaggattcgatttcaccgagttcgatacggaagccgcgaatcttcacttgatgatcgagtcggccgacatattcgatgacgccatcggcgcgataacgtgccagatcacctgtgcggtacaggcgcccgccctgcgtgctgaacggatcaggcatgaagcgttcggcggtcagttccgggcgctggaaatagccacgggccaatagatcgccagcaatcaccagctcgccgacgacgcccaccgggactggttgaccaccgctgtccagcagataaatggcgcgtccagccaaggggcggccgatcggcatggttttcggcagtggcatttgcccggtgacgtaatccgtgcaatcgagcaccgtggcactgaccgtggtttccgtagggccataggtgttgagcaggcgcacatggccaagtcccgctttgccccacgctgccacgccttccggtggcatggcttcgccgccgacgatcacctggcgcagcgggccgtagtcacgcacaccggcagcggcaaaatccctcgccagcatgttccagtacgtggtggtcaggtcgctgaccgtgaattgcttgtcgagcaactgccggtaccaggtttcgctgtcccagatgtccggcccgcgcagtaccaccgacgcgccgcagatcagcgccgggtagagctgttcgacaaaggcatcgaagttgaacgtggcaaattgcagcgaccgatcggcgggtgtcaggccgaggaattgcagggcgacttgcgcgtgtcgggtcaacgccgcctgggtaatccccacaccttttggtcgaccggtggaacctgaggtgaacatcacatacgccaggttatggccatgggtacggcagggcggattgtcactgtgcgcgctgtcggcgaggtcgagttcatcgacgcacagtacgctcaccgcgtcgacagaaggcaggcgctggagcaaagaacgctggctgagcagcacgctcaggccgctgtcttcgatcatccaggtcaggcgttcctgcgggtattcggggtcgagaggcacgtacacgccgccggccttgagcaccgcgagcaggctgacgatcatccgcgccgaacgctcgaccgcgatgcctaccagcacttccgggcccacgccatagccgatcagggtctgcgccaggccattggctgccgagttgagttgggcatagctcaggcgcacgtcatcgcaaatcagcgcgagggcctgcggcgtggccagtgcctggcgttcgaagagctgatgcacgcctgcgcttggcaatggcgcagcggctgggttccattgttcgcgttgctgacggcactcggtgtcactcagcagcggcagttcgctcagggcaatatcgggatttgcggtgatggcgtgcaacaggttctgccaatgcccggccaaccgctcgatggtggcggggctgtacaggtcgcggctgaattcaatgttggcatcgatgcggttcagggaataactgacgtccagcgacaggtcgaatttcgcctggccgctgccggcatcgacaaaatccagggtcaattcgcccagattcagcggcaccgaggcgccgccgtccgtgcgccagttgaacagcacctggaacaacggattgatctgctgactgctttgcagttgcaggtcgtcgaagctcaactccagcggatagtcggcatggtcgagcgcggccagcgattcgcggcgcagacgtagcagaaagtccttgcaaggcaactgcgggtcaatccgcacgcgatagacctgggtgctgacaaagaatccgaccagatcctgaatttcactgcggttgcgtgtggcgttgggcacgccgacggtgaaatcgtcctgaccactgtagcggctcaggagcaattgccaggcgcccagggcgaccacaaagggagtcaaaccgtgctgctggcagaagcgattgagtgcttgcgccaaggtggcgggcaggctgaagtcgtgtttgccggccgcatggctgtgctggtcattgcgcgcaaagtccaccggcagatccagcggcggcaacgtctggcccaggtaattctgccagtattcggcgctggtcttgcaggccgggctgtgcagatagtcgccacgctgccagtcggcatagtcggcgtactggatggccgggcgcggcagtggcgcgctcatgcccattgccgcttgcgcgtaggcgcgggtcaggtcctgcatcagaatcgcgttggaccaggcgtccgaggcgatatggtgcatgttgagcagcagcaagtgttccgtgtcggccacctgcagcaatgtggcgcgcatcagcggcgcctgcttcaggtcgaagggcttggcggcctcttcggcagtgcgcaggtcaatctgctgttcgcgcgcttcagcgctcagcccacgcagatcatcgaagcccaactgcagcgttgcgtgtgcatcgaccacctgcatggctaccccgtcgatctcgacgatcgcgctgcgcaggacatcgtggcgttcgatgactttattcagcgccatttccagatgctgtgcttgcagggcgccgctcaggcgtacggcgcgtggcaagttgtaggcggcactgtcaggtgtcagctgttgtacgaaccacagtcgctgttgcgcgaaggagaggggggccggggccgggtggggacgggcaatgatgccttgggattgctcgccggcatctgccatcagcagcgccagtacctcatcatcgagtaagtcgttcatcgggctctcgtggttggcagcaccgtgagcgctgacggcgttgccgacagtcgggtccacggcgatagacattcggattgaaggccggcaggacgggcgtccggccggctgcaaaggtgcaatcgatcaagcagtctcgaggggctttttgtgggtgaccactcggcctccctccatcctcaccagttgatcggcgacgtcgaagtagcggtcgtcgtgggagatcacgatgatggtcttgcccatctgtttcagctccggcagcagctcggtgtagaagatgcgccggaaggccgggtcctgatcggcagcccattcgtcgaacaccagcaccggacgctcttccagccaggcgttgatcagcgccaggcgtttgcgctggccggtggacagatcggtggtactgaaaacaccgtcgttgatgctcaccttgtgcgcaatctccaggcgttccagatagcggctggtgtcggccggcacttgtttgtcgccctgtaccagttcatcgaacaggtagtagtcggcgaagatcgtggtgaacagttggcgatagtcatcgcgcgcctgggcatcgaccacctggccattgagcaggacttccccgcgttgcggcgcatacaggcccagcaacaatttgatcagggtggttttgccgccgccgttctcgccgacgatgaacacgatgtcaccctgcgcgatgttcagattgaccggacccagctcaaacgctgcgctgccctgaaccggcgggaaggcgtagtgcacgttgtgcatttgcaactgttgcactgcggtcttgctcgcgggcgtcgactcgcgcaggagcaagtgcggttccggcgaggaaaactgctcggccagttcggcaatgcgtttgaaggcaatgttcgcgcgactgaccaccggcaacgtggtgaccagatattccagtgggcctttcatgtacagcagcaccagcacgaaaccgctgagcacggctttgtcggtaccgagccagaacgattgcagcgcgagggccagaccgatcaccacgaaaaacagcatcgagccaaaggttttcgccaccacgaacgtgttgatcgaacggatgtgtgtgttacagatgtaatccgccgtgccctcgatgcgctggctgaacatgcgttggcggcgcgggcgatgaatacgcaattccttggcacccgcggcgatcgcgctgtagtgcttttgcagttcgtcctcggcttctcgcgccgcttcgaaacctttgatgcctttggcccgggcaatgtattgcacgacggtgccgatcacgatcgcgatcaacagcagggcaaacatcggcagggacaggtaggccaggtaactcaggcaaccgagggtgacggtgaaagcgatcgccagcggcgcaaaggaaaacgcgaaatcactcacggtgtcgacgtcatgggtcagcaccggaatcaggcgatgactgcgaaaccgttcgatctgctcgataggtgccagcaggactttttcgccgagtgatttgcgcaggccggcgatgatgtgctggccaacatggttggtgccgatgtccgacagaatcgaagtcaacaaggcaaacgcgcagaggccggcaaacgtcagcagcactgtcgctgacggaacgccgctgccgttcagggctttgttgatggtcgccagcagtgcggtgacgctgacgccaccaagcatgccgagcaggatcgacagcgccacgacgacccggtaaggcttgagcaggccgaggacttcactgatggctccgcgcgattttgtggtcatggaggtttccgcttctagtgccgctaacggcatcgtttcaaggattgggctggttaaaagacgaaacccgtgggcggcgatttagccgaccacgggtttatcgaggctgaagcgacgagcgagcggcccgcgccgccatggcggctgtcgttaccgctgtccttagagatcgcgcgcgacgcgaaaaccgatccagtcgccgcgcgtatcgctgtaggtggcgttgcgattacccgagcgcgagaacaccggtgcttcaccccagtcgttgccgcggatgcggcggatcttgcagtcaccggtcagccaggcactgccgtcactcggcgcgccgacatagttttcgttgtagcagtcggcggtccattcatagatgttgccgtgcatgtcgtagacgccgaaggcgttcgccggaaacttgcccgccggcgcggtgaagttgtagccgtcggcggcgccataggtattggcgtgtttggcgatgctgtattccttgccttcatcgaaggggaacgggaaaggtccggcgctgccggcacgggcggcgtattcacgcagcgattcgctgaccagtcgatacgatttaccggttttcttcgacagccaggctacataggcctcggcctcgggaaagtccatgcacaccgccggatgcttgtcggtgtactgctttttcggatcgctgcccgcgtagtcgggaataccggccttgcacgcgcggcccgggcgtttgtcgccgtcgggcatctgatagccggtgtcggcgaggtaggcgtcccattgccctttgagcacctggaaacgactgatggccagcggtttggcaaaggtcaccgggtgcatcggaccttcgtccggctcgcggccgacttcgtcctccggggtgcccatggtgaaggtgccggtgggcagcacgaccatttccgggcagtccttgcagtccttgaagactttgcccggtttgagcggttcggccgcttgcgccagccccggcaaggcacaaccgagcaatgcggccagaccgagcgcgggcaacgcattcaaggaaaaattacgcggttcactactgttcatcatgattctcgataacaggttgaaaggaaacgtgggagcgtggcgcctacagctgtttggccagtaacgccatcaaacgatcgatttgcgcttcgtcgttgagcaggcccggtgcagtacgaatcaccgggcccacgtcgcggttcacggcgtcggcgaccacccggttttgcatcaggtacgcggcgactttgtcgcagtcctggcccttgacccgaaagaaggtaaaaccggccgacagttgcgtgctcagcggcgtgacgagttcgatttgcgggtgttccagcaggcgtttcttcaggtagctgttgagcgcgtggatgcgcgcttcgacctcggccttgcccaattgcagatgcagcttgaaggcttcgtccagcgcccagcgatactcgaaagagtggtagccaccgggcgtcatggtggtggaaaacgcggtggcctcggagaaggtcggggtgatcggcgtcacgtatctgacctcctcgaaacggctgcagacgatgccggtgccgcgcgggccaaacatccacttgtgggtgccggcgatgaagaaatcgcagttcatctgcgcgaagctcaggttgtcgacgccgaagccgtgcacgccgtcgaccacataaatgatccggtcggcatcgctgcggccacggttgtgtttgtcgacgatggcgccgatctcaccgatcggcagcttcacgccgctgcccgaatgcacccagcacatccccagcacacgggtttccgggcggatggccgtgtcgatggcggcgaggatttcggctttggtcgcggtctgcggatccttgaacagacggatcttgcgcacctgcgtgccttcacgttccttgcgcaaggcgaggatggtgtgggtggcgtagtgttcgtgggcggtggtgaggatttcctgatcggggcgcacatgcacaccgccgtaaatcatcgtcagaccttcagtggtgctgccggtcagggcgatctgtttagcgtttacctgcaggtattggccggcccagacgcggacgttttcctcgcgctgctcgatcacgccgaggtcccaatccatggccaggccgggatttttgtcgagggcggcgcgatgccgttcaatcgcttcgcgcaccggttgcgggtgcgaggtgatcaggaagttggaaaagtgcaggtagtccggatcctgattgaacagttgctgcaactgcgtccacttgctgcgcggcattggcgcagcgggcgcagccggggcggcagcgctggcgatgttcggcaggctggcgcccagtggcagcgcagcggcgagcagtccggcctgtttcagaaaatcacgacgattgctcatggctgcgtcgttccctgcgcgttggccagcgccggtttcgcggctttttcgacctgatcccagacgcgcaggaagttgccgccccagagtttgccgatgtcggcttcggagtaaccgcgcgacagcagttcagcggtgacattgcggatctcgccgacgttctcgaaacctttgacgccgccgccttcattgaagtcggagctgataccgacatggtcgatgccgatcttgcgcacggcgtattcgatggcgtcgccgaaatccttgaggctggccttcggttcgtcttcgaggatcgcgtacagacggctggcgtacaggccgaatttcgtttcggaccaggccgcaatgatcgggtcgcccggcatcagcgccatcgccaggtttggcaggggcggcaggtcgaattccttgcgcagttcgttgaggcgatcctgggtcttctgggtcagcggccgcaggtactgggagaacgcgacgatttgcaccacaccgccgctgttcttgatcaactgcatctctttgtcgctgaggttgcgtgggatgtcgaccatcgcgcgcggcgccgagtgcgaggcaatcagtggcgtacggctcagctgtgcgacttgttcgagggctttggtcgacatttgtgatacgtcgatgattacgcccagatcattgaggcgcttgaccgcctgcttgcccagatcggagaggccatcgagggcgtccggagaatcattgagaaatggcaacgggcgcgatgagtccgcccagtcgttgttaccgatatagctgaaaccgaacatgcgcatgccgcgcgccgtccacaggtccagcagattcaagtcatggcccagtggataggcgttaagcatgctgatgaaaatcgcgaacttgccttcgccgtgcaggcggcgcatatcgtccggggtgtaggcgattgcgacctgattggggaagtcgcgcaccatgccggaaatgatcttgtagcggatctcttgctggttgcgggcttcgtcgatgaagcccgcggtaggtttgtgcggggcatcggggccgttccacatttccggccagccgaaaatggtcagcgccgcgccagacaaacgaccgcgactggccttggccaggtcgaactggccggagccatccttgtcggcctcgtgaccgtcggtgccgaagttctgcatcaggctgacatggctgtcgaaggagagcatgcgttcgtgcagttcatctgcctgtttcacaaccttggcggaatagcctaggtcgtccttgaaccagtgatgccagacggcaaagcctgcaccggcactgatcgccagggctaagggcaggccgatgaatagagcctttttcgaacgtggttttgtcattgccatctcagtcgggttcgccatcgaggtgcaggcgcaaagcctttgctatctgggaagaacgagtggatggccgtggaatttagcttgccaggttaaaagatcgcagccttcggcagctcctgcagggatatacattcgatgtaggagctgccgaaggctgcgatcttttcaaacccacataaatttacccgcgcaacaaacgttctagcttggataaagcctgcttcatggctgacacaggtagggcaatgaagatttctcgacgatggttcatggcaggtctggcgctgactggcgctgcggtgcctgcggcttggtttgggcatcgtgaatggacgaagccggatccgacgatcactccgggtgaagcgtctttcgacgtcgccgacctcgccggacaacgcttggccagtgccttgcggggcgtctgggatattcgcttcgaaggccgtgacgcaggccttgaagggcttccggccaagggcctgcaagtgttcctcgacatcggccagaaaggccgtggcgtctgtggttttcttgatacaccggagcgtttgcgctccggcgaaacacctcgttaccgaattcttggcgatctcgccggtgccgacgccgcgaagttgacctggcggctgatcggtgcgcaaggccagatcaactatgagctggagatgatcctcgacgaggtctgggccgatttcggcaacgccggcaaaggcaccctcagcggtaaagccttgcgcctggatcgccctctggccttgcccgcacaggacaacggcttcgtagcggtcaagcgactgtttcccgaagcgcgtgaacgtacgccgctgaatccgacgctgctggcctggctgatttcccccgagcaccggctgttccaccagttgtggcatgcgacgcgggacaagtggcacaccttgccagaggacaagcgcgaagccttgcgcggcatcggctggcagccggggccgcgcgacaaggagcgcgatgctcgtgggccgcgcaaggatcgcaatggttccggcgtcgatttcttctttatgcaccggcacatgctcggcacggcgcgctcgatgcaggacctgccatcgtggcaatactttccgctgccacagccggaattgatccgtgatcgcccgggtttcgcccgttacttcgacaatcatgacggcacggcgctgccgcctccgtggctggccgacggtgatgatgagtacagcaagtgggtcagcgatctcaagacggccgagacctacgaaagcaactttcaggtctgggagtcgcaataccgtgatccggcgtatctggccagactgacgctgggccagttcggttccgaggtggagctgggtctgcacgactggctgcacatgcgctgggcgtctgtgccgcgcgatccgtccaacggtcagcccgtgccttttgcgcgtgatcctgccgacttcgctgcacgttggtatggcccggaaaatgacttccttggcgacccgttttcatcccacgtcaacccgtcgttctggcacttccatggctggatcgacgatcgtattgaagactggtttcgcgctcacgagcgtttccatccgggggaggtcacgcgcaaggtggtcaatggtgtgcagtggtttgcaccgggacgctggaacgaagtcgatgacccctggctgggtccggtcacccatggttgcagcaccacgccggggttgcaggcgggcaagaccgtggagatggacccggaaaccatgaagctggcgctacgcatcaccttcctcaacgacgaggaaaaactcgccgggctgttccgccgcgtgccgcaacgaccgtggtatgcgcgcaatctgaaggccaaacagactcaggcctgattaccgcgtcaacttcttcgcgagcaggctcgctcccacaggttggccgcatcccaccagttgaaatgcgctctcttgtgggagcgagcctgctcgcgaaagcgctgggccgggctgcgcgattacagtgcctgccacccgccgcccaatgccttgtacaaggcaatactcgcctgcattcgcgacagccgcagttgcacgttctggtcctgcgccgcatacagcgtgcgctgggtttccaatacggtcagcaagtcctcggcgccggcctgatagcggctctgggcgatgttgaaggcggtttgcgcctggttcagctcttcgctctgccactgccgttgttcatcgaggccacggatgctgttgagggctttttcgacgtcggcgaaaccgttgatgatcgcgcctcgataggtttccagcagctcctgctgacgagccgtcgctttgtcgcgttcggcgcccaaacgaccattgttaaagatcggtgcgatcagcccgccggtgaggttgtagaacggactgcgccacaggtcacccgcctgattggcgccggagccgatgctcgcgctcagggtgatttttggcagcatcgccgcgcgagccacggtgacgtccgcctgggctgccgccagttgcgcctcggcgcgggcaatgtccgggcggcgggtcagcagttcgctgggcaggccggcagcaatctgcggccattgcaattgatcgaaggactcatgaccggtcggcaggtcttgcactggacgcccgagcagcgctgccagcgcgattcgcgcatcttgggcttgttgccggacggtcggcagttggcgttgttgtgcggccaccaggcttttctgctgggccagctccagcgcggtggccgagccggcgttgtagcgcgtctgcaccagttgcagaacgctttgcgcattggccaggttcagctcggcaatgcgactctgctcctgcagcgacagcacctgggtgtaactgttggcgacgccgctgagcaaggtcaattcgacggtggcgcgatcgaactcgctggcttgcaggctgaactgtgcactgtcgcgcgatgcgcgcttgccgccccagaagtcgatttcgtaactggcgttgaggccgacatcgaagtagtccacagccttgttgctgctgtcggcatccagttgacggtaaccttcgccacgcaacagcttctgccgattggcgttgccggtgccttgtatttccggcaattgcgagccactggcaatgacggtggcagcgcgcgcctgacgcacgcgagcgatggctgcggccagatcataactgccgacctgagcctgttcgatcagttgattgagctgcgggctggcgaagcgcgtccaccagcgcagggtgtcgcgttcggcgcgggtgtcgtgtggcgattgccacgcaacaggcgggacaatgccgctgtccggacgttgtgcggaactgccgcaagcgctgagtatcaggcagacggtcaacaggctgaggcgcggtttcatagagcgatcattcactggtaagggccgtgaccgggtcgagtcgggcagctttgcgggccggcatgaagccgaagacaacaccggtgaccaaggcgcaaccaaaagcgccgagtaccgccatcaacgagaacgctaccgcgacttcactgagaatcagcacgccgccaatgatcagcgccagggcgatgccggcgatgccgccgaccaccgagagcatcaccgcttcagtgagaaactggcgcaggatgtcgcgctgacgggcgccggtggccatgcggataccgatctcgcgggtgcgttcgcggacggtcatgagcatgatgttcatcacgccgatgccgccgaccagcaacgagatcgccgcaatcgagccgagcatcagcgacagggtgttttgcgtgcgcgcttcggcctggatcatcgcggcgttgttggtcagttcgaaatcctttttgccgttgtgcaggttcagcatcaattgttcgatggcatgttcggtgtccttgaccttgcgtgcgtcggcggcagcgatggccacgtactcgggattgcgcgtgccgaacagcctgacgctggcagcggaatagggcacggcgatgcggttgtcgctgtcggagtcgccggagctggcacctttttccgcgagcaccccgaccacctgaaacggcacgttctcgatcaggatgtactggccgatcggattgggtatgtccttgaggagtttgctccgcaccttgtgcccgatcaccgcaacggcggctgcgctctgttcatcggcctcagtgaagtaactgccctgaaccactggccagttgaagatcgccgggaagttggtgtcattgccgccgacgtaactgaggtggtcggcgttgccgaagcgcacgccggcttcggcgccattgaccggcatgatccgctgcacttgcggcaggctcgccagagcgtgcacatcgtcgagggtgatgatgcccggtggcgttcgcgggttgggcgccgagccgctgagataaatgatgttcgaaccgaacgcgcccatttgcgccatgacctgacgcttgctgccttcgccgacggcgagcatcaccaccaccgaggcgacgccgatgatgatgccgagcagggtcagcgcggtgcggaagcggttgatccacatcactcgccaggcggcgtgcagggcatcgaccagttcacctttccaggcgccggtagcttcggcgccttcgctcaagcgcttgcgcagatccaccgcttgcagggcgccgggattggcactgtgctgggcatcggggttgtttctggcgctatcgctgatgatcaagccatcgctgatttcgataatgcgcttggcccgcgccgccacttcgcggtcgtgggtgatgagaatgaccacgtggccctggctcgccagttcatcgagcagcgccatgacttctttgccgctgtggctgtcgagggcgccggtcggttcgtcggccagaatgatgtgaccgccattcatcagtgcgcgagcaatcgacacgcgttgttgctggccgccggacagctgatgggggcggttgccggtgcgcgcggccagaccgagacggtcgagcagggcggcggcgcgcgcatggcgttcggcggcgggtgtaccggcgtagatggccggcatctcgacgttctcctgggccgagccggacggaatcaggtgatagccctggaacacgaaaccgaaggcttcgcgccgcagccaggccagttcatcgctgtcgaggccggcgacgttttccccggcgaagcggtattcgccggacgtcggccggtcgaggcagccgagaatgttcatcagtgtcgatttaccggaaccggacgcgccgacaatcgccacgaactcgccggcgtgaatcgacaggtcgatgccgcgcaacacgtgaacttcgggagcgtcaccgccgccgtaggatttgcggatgtcctgcaggtcgatcagaggcgtttgcattcaacctccgctgccgtcggccgggccgatcagcaagtgatcgtcttcgttcaagccctcgataatctgcactttgagacggtcgctgatgccggtgcgtacttcgcgggactgaatctggccattggcggcgatgacctgcgcggtctgccgattggccaccgcgctgccttgcagggcagcgaccggtgccgtgagaacgttttttgcctggtcggcaacgaagaacacttgcgtggtcatctctgccatcaaggcgttgtcggcgttatcgacgtccagcagcacggtgtacagcaccacgcgcgcgctgccgcttttactcgaactggccgggctgccgccgccctgactggtttgatccagcggtttggggggtaccggcagaatttgtcgtacggtgctgctccagcgccgattaccaccgctgagcgtggtgaagtacgcggtcatgcccggtttgacatggccgatgtccgcctcggagacctcagcccagaccgtcattggcgacagtttggcgatacgcagaatcagcggcgtctgttgctgggcattgagggtctggccttcgcgggcatcgagtgcaaccaccgtgccttccatcggcgcatagatgcgcgtgtaaccgagttcggcctggtcactgcgcagactggcctcggcctgacggatctgcgcacggaacatgtcgatccgcgcctgggtggccttgagttcggcgcgcgcggtctgcacgtcttcttcgcgggtggcgccgccggccgcgaggttctgctggcgttggtacttctgtcgtgccaattcgtgctgcgcctgttgttcttgcaactgcgccttgaggttctcgatggagaactggctggcgtcgagtttggccttttgcgtcgatggatcgatttcgaccagcaattgtccttgcttgaccacgtcgccgacttccacgtggattttgcggatctgcccggaagcctgcgcaccgacatccacgtagcgccgtggctgcaacgtgcccagcgcggtgacgctgctttcaatgtcgccgcgactgacttgcacggtggcgaacttgtcccggccagggggcaatatctgccaggcggctacggcgacaacgggaatcagacaaagggctacgagcagggcgcgtcgggcggggcggggacgtttcatgcagggttccggccagtggaaatcgacccgtcatccagccggcaccgcacacgggccaagaccgaacgctggcgcaggaggcgacagatacggggaactgttttttaaacgagggacgcgttgggtaatttaagcgctgaaaaacgcggtaacaggtatagaagctaacaatttgtcgggcaaatcgaaacagcgctttaaatctatatgagaattactataaattacgcatctgaaattgccagcatcgtgccactgtcgttttgacggtggcgggtgtggctcaaggatcgaaaccgcactgctgcggccgggagtcatgttggaaaactactatcgcgagctggtgtgtttcctgaacgccaagctgggcaaccgccaggttgccgaggatgtggtgcatgacgcctatttgcgcgtactcgagcgctccagcgacacgccgatcgagcagccccgggcgtttctttatcgaacggcattgaatctggtcatcgacgaccatcgtcgcaatgcctcgcgccaggtcgaatcgctggaagtgctcgacaacgaagagcgctatttcaccccgtcgccccatggcaccctcgatcacggtcaacgcctggagatgctccagcgcgcgctggccgaattatcgccgctgtgccgcgaaagctttctgctgcgcaagatcgaaggcctgtcccacaacgaaatcgccgcaagcctgggtatttccaaagcgctggtggagaagcacatcgtcaatgccatgaaacattgccgggtgcgcatcaaacaatgggacgcccattgatccctcctcagtaaatttcttttcaccgtcctcgttcctactcaacagacgatctgctgtcctgctccgggccggtcaggtcacccaggctttatccccacggttgaggggttcatccagaggacactggaaatgacacaggcaattgcatcgcccatcgttcacgacctgatcggcgtcggtttcggcccttcgaacctggcgctggccatcgctctgcaagagcgcggcccgatccagggtgagctggatgtgctgttcctcgacaagcaggccaactacagctggcacggcaataccctgtcgacgcaaagcgagttgcagatttccttcctcaaggatctggtgaccctgcgtaatccgaccagcccgtattcgttcgtcaattacctcaagtaccacgggcgtctggtcgacttcatcaacctcggcaccttttacccatgccgcatggagtacaacgattacctgcgctgggtcgccgggcagttcaccgagcagagccgttacggcgaagaagtgctgaccatcgagccggtgctgcacaaccatcaggttgaagcattgcgggttatttcccgtggcagcgacggcctgcaacatgtgcgcacgacccgctcggtggtggtcagcgccggcggcacgccgcgtattcccgaggcgttcaaggcgctgaagggcgacactcgcgtgttccaccactcgcagtatctgtcgcagatggccaagcagccgtgcgtgaacaaccagccgatgagcattgcgatcatcggtggtgggcagagcgcggcggaagcctttatcgatctgaacgattcgttcccgtcggtgcaggtcgacatgatcctgcgcggctcggcgttgaagcctgcggacgacagcccgttcgtcaacgaagtgttctcgccggaattcaccgacctggtgttccagcagaacagcgccgagcgtgagcgcttggtcaacgagtaccacaacaccaactattcggtggtcgacatcgacctgatcgagcgcatctacggcatcttctatcgtcagaaggtttccgggattgcccgtcacgcgttccgcacgctgaccaccgtcgagagcgctaccgctaccgaaaacggtatcgcgttggccgtgcgaaacaacgccaccggcgaagtcaccgtgcgcaattacgacgctgtggttctggccaccggctacgaacggcagatgcaccgcaaactgctggcaccgctggaagagtacctgggcgacttcgaggttgatcgcaactacaaactgatcaccgacgagcgctgcaaggccggcatctacatgcagggcttctgccaggccagccatggtctgagcgacacgttgctgtcggtgttgccgatccgcgcggacgagattgccggttctttgtatgagcatggcaagcatcgtgggcatcgttcgatggcggatctgctgttggcgactgccagctgaatctgctgcgcctgaaccagatcgttcccacgctctgcgtgggaatgcctctacggacgctccgcgttcggccttcgatagggacgcggagcgtcctgggctgcattcccacgcagagcgtgggaacgatcatcctgaacccttcctgaacatcccccacattccccgacacacggccttttgcgggtttactctccaatcatcggggcgtaagcttcgcgcgttttcatcaatagcggagacccacagtgggtacttgttcgagtgacagttgtcggccggtctcggtaaccggcagattctcggcaagataacgcgcagcctttctctgccgttgtctcgccgtaaagcgagcagcggcatcccgtgcatgacccgtcctgggccatgtctggacgttccttctcatcgacgctgaacagagcgtgattgcgactttattgtcgtgatcgcagccctatcgacacgcctgtcttttctgaccggcgcgccaggccttgccgtgccggtttttccggcgcacgaggcgcggccgtacctgctcgacggtttcccggctgaccataggggcaacagccatgaaacttacgctcaaggaattcttcgcaggttttctgcggacccgccacatcgcccggcatttccgtcgtctggcgttgctggaatcgatcaacgacaccacggtcagccgtgaagtcccacccactctggccaacaccctggtcgatgccgcgcattgcgacaccgctggtttactgtcgtcactcggcacccactccgatgggcttaccgatttcgaagtcgatgcgctgcgtgcgcaatacggcctcaacgaagtcgagcacgagcagccgctgccttggtggattcacctgtggcactgctacaagaacccgttcaacctgctgctgacgttgttggcagtggtctcgtggctgaccgaagacctcaaggccgccgtggtgattttctccatggtggtgctgtcgacgctgctgcgcttctggcaggaaagcaaatccaaccaggccgccgatgcgctgaaagccatggtcagcaacaccgccacggtgatgcgccgtgacgcgccgcgcagcgaattgccgatcaagcaattggtgccgggcgacctgatcgtgctctcggccggtgacatgattcctgccgattgccgggtgctcagcgccaaggacctgttcgtcagtcaggcagcgatgaccggcgaatcgatgccggtggagaagtttccgcgtcaggccgatcgcgatacgcgcaatccactggagctggacaacatcctgttcatgggcaccaacgtcgtgtcgggtacggcggtggcggtgattctcaccaccggcaacagcacctattttggcgcgttggcgcagcgggttggcgcaaccgatcgcgcagtgacttcgttccagcaaggtgtcaacaaagtcagctggctgttgatccgtttcatgttcgtgatggcgccgctggtgctgttcatcaatggtttcaccaagggcgactggacggaagcactgctgttcgcgttgtcgattgccgtcggcctgaccccggaaatgctgccgatgatcgtcacctcgacgctggccaaaggcgcggtgttcctgtcgcgcaaaaaagtcatcgtcaaacgtctcgacgcaatccagaacttcggcgccatggacgtgctgtgcaccgacaagaccggcacgctgacccaggacaagatcttcctggcgcgcaatgtcgatgtctggggcgccgattccgacgacgtgctggaaatggcttacctcaacagctactaccagaccggcctgaaaaacctgctcgatgtcgctgtactggaacacgtggaagtccaccgtgaactgaaagtcggcacggcatttcgcaaggtcgacgagatcccgttcgacttcaatcgtcggcgcatgtcggtggtggtcgaagggcgtggccagccacatcaactgatctgcaaaggtgccgtggaagaagtcttggcggtgtgcagccgcgtacgtcatggcgaggtcgatgaagccttgagcgatgaattgctgacccggattcgtcaggtcaccgcagcattcaacgctgaaggcttgcgcgtggtggcggtggccgcccgctcgatgcccgcaggtcgcgaaatttacagcctggcggatgaacaggaactgacgctgatcggttacgtggcgttcctcgatccaccgaaggaaagcaccgcgccagcgctcaaggccctggccgaacatggcgtggcagtgaaagtgctgaccggcgacaacgagctggtaaccgcaaagatctgccgcgaagtcggtctcgctcagcagggcttgctcctgggtaacgacgttgaacgcatgagcgatgccgaactggccgtggccgtagagaccaccaacgtcttcgccaaactgacgccgtcgcacaaggaacgcatcgtgcgcatcctcaaaggcaacggtcacgtagtcgggttcatgggtgacggcatcaacgacgcacccgcactgcgcaccgccgacatcggcatttccgtggacagcgcggtggacatcgccaaggaagcggccgacatcatcctcctcgaaaagagcctgatggtgctggaggagggcgtgctcgaagggcggcgcaccttcgccaacatgctcaagtacatcaagatgaccgccagctccaacttcggcaacgtgttttcggtgctggtcgccagtgcgttcattccgttcctgccgatgctgccgatgcatctgctggtgcagaacctgctctacgacatttcgcagattgccattccgttcgataacgtcgatgaggacatgctgaaaaaaccacaacgctggcagccgggtgacgtcgggcgcttcatgctgttcttcggcccgatcagttcgatctttgacatcaccacgttcgccttgatgtggtacgtattcgatgccaacaccccggatcaccagaccctgtttcagtccggctggttcgtggtcgggttgctgacccagacgctgatcgtgcacatgatccgcacgccgaagattccgttcctgcaaagccgtgcagcgatgccgctgctggtgatgaccggaatcatcatggcggttggcatcttcctgccgatggggccgctggcgcactacttcaaattgcaggcgctgccgtcgctgtacttcgtgttcctgccggtgatcctgctggcgtacatggcgctgacccaggcggtgaaagggttctacatccgccggttcggctggcaataacagcacggccaacaccgttcccctgtgggagcgagcctgctcgcgaaggcgttttttcagccacagctgtagtggctgacactccgctttcgcgagcaggctcgctcccacagggggaatttgtgttctcaaggatttcatcatgcaagccatcaacaacctcaacctcgattcactgctcgacaccctcgtcagcctcagcgccgcgttcatcctcggtggtctgatcggcttcgagcgccagtaccggcaacgcaccgccggcctgcgcaccaatgtgctggtcgcggtcggtgcagcgattttcgtcgacatggccaaccgtctcgccggcgctgaaggcgcggtgcgcgtggttgcctacgtggtctccggcatcggttttctcggcgccggggtgatcatgcgcgaagagggcaacgtgcgcggtctcaataccgccgcgaccctgtggacttcggcggcggtgggcgcctgtgccggtgccgatctgcttgccgaagccgtgctcggcacgctgttcatcctcgccgccaacactttgctgcggccgatcgtcaacaacatcaaccgtcagccactggacgtggtctcggcggaagtcaccaacatcgtctatgtcatcgcccgacgctcacagcaaactgccgtgttcgccttgctcgaagccgaactggagcgcagcaactacccggccagtgatgttgatgtgcatgcgtttggtgccgatgaaatcgagattgaagcgacgctggcgacaacctcggtcgatggcgatgaactcgacgctttggtcgcgcgaatttccacgtcggcgctggtggtgcaggcgttctggagtccgagtaccaccgaatgaaccgcgctcgtccgttcagtagcaccgccacatccggtcataccgggtgtggcttttttgcttgctctcggctgttctccattcatttttaagattcgtcctacaggcgtcacggctccttttgcttagccttgtcattcacgtgatgagcgtgattttcctgggctgtgaaagacaatgtcctacaaacgctggcgaatccttattgccgacgagcaacggtcgctgcatgtgcgaatcggcaaatgcctcgacgaactcggctatcgcgggtacgcgtcggtgtattcgtttcgtgagctgctgggtacgacgcattactcgtccgatccgtttgagcactatgacctgctgatcatcaacgctgagctgatagcggtaggtggagacgatcctttgcgtttttttcaatgcaacctgcagattcgtcatgccgttatttacgacaaacgtcgcggcgaggcaggcgcgcaggcgatatacagcgctgatcgacgctatttgaccctgatccgtataccggatcggcagacactcggccctttgatcgctgacctggcgacagcacagtgatgggcaggactcggatgagtaaccttttttttcggattattcctacagaacccgccacgcagcttgcgtagtcttgccgcacccagaaaccgtgaccccgggagatcgatcatgatcaataaagccctgcgcattctgatcgcagaccctcagcattttcaccggatgaaaatcgagcgactgttcaatggcctcaattattaccgcattgctccggtgcagaaccttaccgagctgctgactctggtggactacggttgcgagcccttcgatgtggtggtcatcaacgccgaactcgctgcaggctcactggatctgctgggttttttcctcgacaacccacaggttcgtcaggcgttgatctacaacgagcaaacggcgccgttgcagttggcttccggcttcgctcaggaaaatgtacagatcagccatttgtcactgccatcaaaacagttgatcgagcagttgatggcgctggtcgacgctccggcacgggcacagacgttatcagcccccagggtaaatccgttggcgcagagcgctgcgcatgcatagaaaagcatttcctgcacctgtcagatctgacaggtgatttgcgcgccgttacgtgtaacagtccctgcgcagccactgagtccggagcagccccaatcggtggcctgttcgtcagactttgtactgggagtggccatgaagtcagcgctgatcgtcgacgatcatccagtggtgtgcgccgccatccggatcgtattgcaagccgaaggattcaagcagatatacgaggcgtccagcggcaacgaggtgctgtcgctctttcgtgaacacaagccgcaactggtgatactcgacctgcgtttaccggcactcgacgggctggaggtgctggcacgcatcaaggccaatgatcctcgttgccgggttctgatcttcagttctcacgaccctctgttttatcaggagcgctgtctgcgtgccggggccatgggctatgtgaccaaaaccaatcagttgcaccatctgcacaaagccattcaggcgctgatgtcgggctacacctatttttcctcgatgccggaaaacctcagtgtgttgaacgcggtgcagactacggaaaagcagatggtcgatcagctttccgatcgtgaattgagcattttcgagcaactggcgcggggcaaatcgaacaaggcgattgccgcggacatgcacctgagccacaaaaccgtcagcacctataaaacccgtctgatgaaaaaactaggggtgtactcattggtgctcttgcgcgagttcgccaagcgcaatcatgtgatctgagcaagcgcacatgaggcacggatgctggattgtctgcctgtggttgagcctgatcgccagtagttgggcgggtgacgcgccgcaggtgctgcaggtattgacccgtaccggcctggcaaacgtccagctgcgactggacaagcaggaccgccagtggctgcgtcagcacccggtgctacgcatgggtatttccggtccggattacccaccgttcgagatcacccgcaatcaccaggaactcgaagggctcaccgccgattacgctgatctgctggcgcagttgctcggcatacgcattgaagtccggcgctttgccaaccgcgatgcggtgatggcggcactcaagcgtggtgacctcgatctgctgggaacctcgaacaattttgaagccgccgacccggatttcatcttgtcccgcgcttacgccgaagatcaaccgatgctggtgactcgcctcgatgaaaagctgccggcagatcttgccggtaagcgcgtggccatggtcgaggactatttgccgctggcgaatgtgcaggggttttatccctatgccagtgtgcagcgttacccttcggcaatggatgcgctcggtgcggtggccttcggcgcggatgatgtgtatctgggcgacttcatcagtgccaactatctgatcaacaccaattatcgcaacgacctgcaattagccggcccgtcggggctggacgccaattcgttcgcttttgccttgttgcgcagcgatgtacgcctcaaacgcatcgtcgacaaggtgctggccgccattcccatggagcatcgccaacgcatcgagcagcgctggagcgttggccttgccgagatggctgaacaatcacgggtgcaactcagtgccagtgagcaggcctggctggaccagcatccacgggtgagggtcggtgccatcgacgattttgcgccgctgactttttttgatgccgacggccgcttcagcgggttgtccgcgcagttgctgagtttgatcagccagcgcagcgggttgaacttcgagatcgtgcgcggggcatcgctggatcgtcagatcgaacagctcaaggccggggagctggatgtgttgccggtggtgacgccgagcagcgagcgtgaaatcgaactgcaatttacccgcgcctatctgaacaatccgtttgtgctggtcagtacgatctctgttcaggggccactcaatcttgatgacctggccggaaaacggctggccatttatcgcggccatcctttgcgcagttatctattgggccgcgtgccgcgtctgcgtctggtcgaggtcaaaagtcccgcggagggcatggcattgattgccaaaggtcaagtcgacgccacggtgagctcgctgttggtggcgcgctttctgatcgcgcgccattaccgcgaacgtctgcgaatcaccggcacggtcggtgatcaaccggcgcgcattgcgctggcgacatccccgcaaatgccggcactgcattcgatcctgaacaaggcgctgttgagcatcgccccgcaacagatggacgaactggttgaacgctggagccacgatgtggtggtggatggcagttactggttacaacatcgccgcgagattctcctggggttcgccggtgcggcggtcttgctggcactcgcgctggcctggatcgtttttcagcgccagcagatccgccgacgccagcaatggttgcagcaattgcaggaagccaaggacgcagcagacgatgcgaatcgggcgaaaactacctttctggcgaccatgagccacgaaatccgcacaccgatgaatgccttgatcggcatgctcgaactggccctcaagcgcgcagaagaaggcgtgaccgatcgcttggcgattcaggtagcgtccaatgccgggcaacaattgctggccttgatcggcgacattctcgacatcgcgcggatcgagtccgggcatttgtccctcgcgcccgaacgcgccaacctgcgcgaactggtggggtcagtgtgtcgggtgtttgaagggctggcgcggcagaagcgcttgctgtggcacatcgaactggatccccgcagcaacgttgatgtgctgattgatccgacgcggttcaaacaagtgctgtcgaatctgctgagcaatgcgatcaagttcactgaagaaggcgaggtcagtctgcggctggtggtgagcgcagcggtaacagaaacactggccgtgaaagtgcggatcgaggacagcggggtcgggatcagccacgacgatcggcggcgcttgttcagcccgttcgtgcaggcgagcaatcactcgcagtcggcacgcagcggttccgggctgggcctggtcatcagtcgcagcctctgcgaaatgatgggcggcacgctgcggctcgacagtacgccgggcgagggaacgcaagtcgaagtcaatcttgaactgccgctgttggccgccctcgctcagaccccggcacccccgcaagccgtcgttgctgctgcgtgttctctgagtgtgctggtggtggacgatcacccggtgaaccgtctgctgctgtgctggcagttgagtgaactcggccatcgcacggtcgacaccgaaaacggtgatgaaggtcttgagcgctggcgtacgcaagcgttcgatgtggtgatcaccgattgcaatatgccgaggcgtaacggttatcaactggcgcaggccattcgtgaagaagaagcgattgccgggcgcaagccttgcctgattcttggttttaccgccaacgcgcaggccgaggaaaggacgcgctgcctgaaggccggcatggacgagtgcctgttcaaaccgatccgcttgcacgatctggcgcaggcattgatggcggccagtcattgcgacatcgcggcggcctccagcgcggcgccagcattggcggagatcgatctgagcaccctggagcaaatggccgggaatgatcgtggcttgatcgagcatttacgcaaggaggtgctgaacagcttgcacctcgatctgcaacgtctggatctgttgcagcaagagcagaatcgcgcagggcttcgcgaactggctcatcacatcaagggtggggcgcagatggtcggggccgcgcgggtggtggcggcgtgtatcgagcttgaacaggcgtgccgcgaagcgcacgcggcgcctttggatacgtcgagcgatgcgttgcgcgaggccatggccggcctcgcgcaacgcctgcaaagctgacgggtgccgagtcaatcccaggcaggcgcaatgcctttcgggctggtcaggcgatggccgcgatccagcgtggcaatcagcgccatgtcggcatcgctcaaggtcagcgccgtggcggcaaggttgctttgcaggttggcgcgtttggtcgacgacggaatcaccgcgtaacccgattgcatcgcccacgccagggtcacttgcgccggggtggcgtgcagacgttcggcgatctgctggatcagcgggtctttcagcacttcaccgtaggcgagggtcatgtacgacgtggtgtggatgccctggcgctgagcgaactcaactactttgcggttctgcaggtacggatgcagttcgatctggttggtcgcgatgttttctgcaccgaccgcagcaatcgcctgcttcatcaaatcgatggtgaagttggacacaccgatctgccgggtcaggcccaggcgcttggcctccagcagcgcgcccatgaattcttccaccggcacctgattttccggcgagggccagtgaatcaaggtcaggtcgaggtagtcggtctgcaatttctgcaggctgtcctttaggctgtcgatcaagcgatccttggcgaagttggcgacccagatcttgctggtgaggaacagctcttcacgcgggatgccgctggcggcgatggcctcgccgacatcggcttcgttttcgtagatttgcgcggtgtcgatgacccggtagccgagttcgagggcagtgctcactgagtcaatgacgacctggccttgcagacgaaacgtaccaaggccgaaagcgggaacagacatgcaggactccaagggttgcagtgggaatgggcaggagtatccgcgtctgcatcgttgagaaaaaccgctggtggggcaaagcactgttgagcagaagtcatgaatccactcagtgatttttgttgtctgggctggccctatcgcgagcaggctcactcctacattggaacgcggtctcctgtaggagtgagcctgctcgcgatggccgcgactcggtctcaggctatatcgctgtgcgcaaattcctcgccgagaaaatcaatcaacgtacgcaccgacggcaacaacccgcgccgcgacggaaagatcgcatgcaccaccccgcatttcggtgcccagcccggaatcaactccacgacgcgcccggcggcaatgtcctctcgcacgactacgctcggcaaatgcgccacgccaaccccggcaattaccgcctgacgcaacgcgatcaaatcatcggtgaccagccgtggcgtatggcgaatcagcgccgtgttgtcattcggccccagcaactcccactgatattcacgctgcgctgcgccccaatgcaggctcggcaaaccattgaggtcagcgggcgagggcggtgacgacaggcgttcgacaaactgtgggctaccgaccaccgattgcgtgctgttgcccagtaccttcatgaccatgtcggtgttttccagcggcggaaaacgcacgcgcagcgcgatgtcgaacccttcatgaagcaagtcgacccggcgattggtgctttcgatgaacaactccaccagcgggtacttgagcatgtagcgcgtgagcatcggcccgacccacgagttgagcagtgccgtcgggcaactcaggcgtaccaggccttgcggttcggagcggttgcgttcgatcagctcggcggcgctctcggcttcgatgcgcatggccagacaacgctggtaataggcctggccgatctcggtcaatgagcaatgacggctggtgcggtgcagcaggcgcacgccgaggcgttcttccaactcggcaatgcgccggctgagttttgatttgggcatgtccagcgcgcgcccggcagcggcgaaaccgtggtgttcgaccacttgagtgaagtaatagagagtgttgaggtcttccaccatcgttctccagatagaacgctaaggccgatttttgcagtctagtgcattaatggtcatggatttaagcttaatccatcgcatcactcacccccattggagacaaccatgaaaaacatcatcggtatctacaccagcccgcgcggccattgggtcggcgatggtttcccggttcgcacgctgttttcctacgacaacctgggcaaacacatcagcccgttcctgctgctcgatcacgccggtcccgccgatttcaccgcgaccaccgaacggcgtggcgttggtcagcatccgcaccgtggtttcgaaaccgtgactatcgtgtatgaaggcgaagtgcagcaccgcgattcgaccggcagtggcggcgtcatcggcccgggcgatgtgcaatggatgacggccgcgtccgggatcctccacgaggagtttcattcggaaaacttcgccaagaccggcggcaaactggaaatggtgcagctgtgggtcaacctgccggccaaggacaaaatggccgcgccgggctaccagaccattctcgacagcgacatcccgagcatcgcgctcaaggacaacgccggccgcctgcgtctgattgccggtgagttcgacggccacaccggcccgtcgcgcacctttacgccaatcgacgtatgggatctgcgcctgaacgccggcaagttgctgacgctggagctgcacgaaggccgcaacaccgcgctggtggtattgaaaggctcggtgcaggtcaacggtgtggaagcggtgcgcgaagggcagttggcgctgttcgagcgtgacggtcatcaactgaccctcgaggccagccaggacgcggtggtgttgctgctcagcggcgagccgatcgacgaaccgatcgtcggccacggcccgttcgtgatgaacaccgagcaggaaattcaccaggccttcgccgacttccagtccggccgcttcggccagatgcacgcttaacgcacaaccactccgctctacacaggacgcgtaggccggttcgaaggccagggatggctgttgcctaaagaaaagaggacacgcacatgaacacagtcaatgccgcgaacttcgacggccagaaaccgaccatcgatgccagcgacgcagccatgctgctgatcgatcaccagagcggtctgttccagatcgtcaaggacatggacgtgccgcaactgcgcgccaatgccatcgcgctggcgaaagcggcgaccctgctcaaaatgccggtaatcaccaccgcctccgtgccgcaaggaccgaacgggccgttgatcccggagattcacgaagcggcgccgcatgcgcaatacgtggcgcgcaaaggcgaaatcaatgcctgggacaatccggaatttcacgcagcggtcaaagctaccggcaagaaaaccctggtgatcgccggcacgttgaccagcgtttgcctggcgttcccgtccatcgctgccgtgcatgaaggctacaaggtgttcgccgtggtcgatgcgtccggtaatcactcgaaactggccactgatctgaccgtcgcccgtttggcccaggccggggtggtgccgatcgacatcatggctacgctttccgagctgcaaggctcgtggaaccgtcccgatgccgagcagtgggcggccgtctacgcccaggccatgccgcattatcaattgctgatcgagagctacctcaaggctcagcaagtcgcgaacgaacacgaagtgctggattcccagcgctgatcgaggctcctgaggccgaccaccggccggcctcttcaacccgcgaggattactgcaatgaccactcaatacaaacgtctggacaagaacaacgctgcggtgctgctggtcgaccatcaggccgggctactgtcgctggtgcgcgatatcgacccggacaagttcaagaacaacgtgctggcgctggccgatctggccaagtacttcaagctgccgacgatcctcaccaccagttttgaaaccggccccaatggcccgctggtgcctgagctgaaagcgctgttcccggatgcgccgtatatcgctcgcccagggcagatcaacgcttgggataacgaagatttcgtcaaggcgatcaaggcgaccggcaagaagcagctgatcattgccggcgtggtcaccgaagtctgcgtggcattccctgcgttgtcggcgctggaagaaggcttcgatgtattcgtggtgactgacgcatccggtacgttcaacgaactgacccgtgaatcggcgtggagccgcatgtccacggccggtgcgcaattgatgacctggttcggtctggcctgcgagctgcatcgcgactggcgcaacgacgttgaggggctgggcacgctgttctccaaccatatccccgactaccgcaacctgttcaccagctacaacagcctgaccaacggtaagtaatctgtcaccccgtaaacctgtgtaggagctgccgcaggctgcgatcttttgatgttgttttttaaagatcaaaagatcgcagcctgcggcagctcctacatgggttttgtagtgtttttgcgcgggcgttcatccgctgaaatcaattgctcctacacttgctcaatctgtgcgatcttctcgcgattggcccccgtcggagttgtttgatgctgtctctgctgaccgaacatccgttgttctgcgcgttgatcctgatcctcctcgatctgggcctgtggcgcctgatctcctcccatggcagcgagtggaaactgctggtgcgggtgctgattttcacgctgttcagcgtgctgttgttcaacgaaggcctcaacccgatggagccggcgccgtgggccgacaacgtgccgttgcacttggcggcgacggggttgcagattggctggtggctgttcggcgcgcgcactctgacggtgttgatcggcgcggtgatgatgcagcgagtcggtcacaccgggcggctgttgcaggacttgctcggcgcggtaattttcctcatcgcgatcattgccgcgctggcctatgtgctggatctgccggtcaaaggcgtgctggcgacgtctggcgcgttggcgatcattgtcggtctggctttgcagagtacgttgagcgatgtgttttccggcatcgtcctcaacaccaccaagccttatcaactcgatgactggatttccatcgacggtaccgaaggtcgggtcaccgacatcgactggcgcgctacgcgtctgcaaaccagccagggcagcatggcggtgattcccaactcgctggcggccaaggccaagatcatcaacttcagtcggccgagcaatatgtttggcgtctcggtcagtgtgcaggtcagtccgcatgcccggcccaattcggtgatcgatgcgctggagcgcgcgatgcagggttgtcggcaattgctcgacacacctgcgccgagcgtggcgctgaaaaactccagcaataacggtgcggaatacgagatcagcgggtttgtcgcctcgatgggcgagaaacgcgtggtgcgcaatcagctgttcgacctggcttaccggcacttgcaggcgtccgggttcaatctgctgtcgagcgatgaaagcaatgcgcccagcaacctgtcgcggccgcgcgcgctgctcgacagttcgccgattttctcgacgttgcgtcaggaagagaaagacaccttcagccagaacatgacgctgaaaacttttcgcgccggcgagacgatccttgaggcgggcgaggtcagcgatcatttgttcatcatcgaatccggcgtggtcacggtgaccttgattcgtcatggtgcgccgttcgagtccgggcgcatggggcccggcgaggtcatcggggaggcgggcattctctccgacacttccgtgccggcgacgtttgccgcaaaaaccttctgtgcgttgtaccgtatcgaaaagacttacctgaaaccgtgtctggatgctcgtcacgacatcaacgatgcgatgaaagccttgctcgattaccgtttgcacaaggcccaggccttgacggcggacgcaccggcggtggtcgccaggaagggttttttgcaatggctgcgcaataaggtctgagcgccttgcgggaaccgggcaagtgagtggtctactcgtcttccgggagattggctatttgtccggcggcgttgcgggactactttaggccacacattcacattccccggaataccgccatgaaagctcgtaccgatttctacaccgcctccccagacgccctgaaagcgatgattgccctggaaaccgcggtcgcgaagctgccgctggaaaagaccctggtcgaactggtcaagttgcgcgcttcgcagatcaatggctgcgcgttctgcatcgacatgcacacggccgatgcgatcaagggcggtgaaacgccgcgtcgtctgtttgcggtcaccgcatggcgtgaagcgccgtttttcagcgagcgcgaacgtgccgcgctgctgtggaccgagtcactgacgcaactgagcctgacccacgccccggatgaagattacgaagtggtcgccgcgcaattctcgccgaaagaaatggtcgacctgaccgtcgcgatcagcaccatcaacagctggaaccgtttggccgtaggctttcgcaaaaccccacaggcctaaacccctacacataaccccgtaggagctgccgaaggctgcgatcttttgatcttgcttctgaaaaaacagatcaaaagatcgcagcctgcggcagctcctacagggggaaggtgggtcagtgggcatccgcacttggcgcggtcggtggctgcaccttgcgcatcaagggcaccatcgccgtggcgatgacgaagcacaccatgatcatcaggaaagtgtcaccgtaggtctgcgtttgcgcctcgcggtaggtcaacagccataactggtgcaggctggcggtgacgccgacgtcaccgctctggcccagtgtcgcgaggttgccaccgacctgcgccagccattgattcagcgcctcattgctgctgttcaaatgttcggccaagcgggtgaagtgcaggttggtgcggtcattgagaatggtcgcgcacgccgcaataccaatcgccccgcccagattgcgcatcaggttgaacaaccccgacgcatgcttcaaacgtgccggtgccaatccacccaaggtcaacgtcaccgccggcggcactgccagttgctgggcaatcccgcgcaacgcttgcggcagcatcaactcgccggcaccccagtcgtgggtgatcgggctgaactcccacatcgacactgcgaacaaacccagaccgatcatcatgatccagcgcaggtccatgcgattggccagaaaggcatacagcggaatcgccatgatctggaacacgccagtggagaaaaccgccagaccaatgtccagtgcgctgtagccgcgcacccggccgagaaacagcggcgtcaggtaaatcgtcgcgaacaggccgatgccggtaacgaatgaaaagaagcagccgagggcgaaattgcgatccttcaaggcgcgcagatcgacgatcggattggccacgtgcaaggtgcggccgatgaaggccaatcccgcgaggccgctgatccacgccgtggtgagaatggtctggtcgctgaaccagttccagcgcgggccttcttcgagggtgtattccagacagccgagaaacagcgcgagaaacaccatgctcaaataatccgcgcccttgagcagcgacagttccggctggtcgattttcaccagcatcggcactgccacagcaacgaaaatccccggcaccaggttgatatagaacagccagtgccacgaggaaatatcagtgatccagccgccgatcaccgggcccatggttggcgccagcgaagcgaccgcgccgatggtggccgcagcgatcacccgttgtttgccggtgaagaaaaagaacgccgtggtgaacaccagcggaatcatcgaaccgccgagaaaaccttgcagggcacggaaagcgatcatgctctggatgttccaggcgatgccgcagagcaggctggcaagcgtgaaaccgaccgccgaagcgcagaacagccagcgcgtcgagaacacccgcgacagccagcccgacaagggaatcacgatgatttcggcgatcaggtaactggtctgcacccaagcggtttcgtcagtaccggcggacagcccaccgccgatatcgcgcagcgacgccgagacgatctggatatccagcagcgcgataaacatgccgatgcacatggtcgcgaaggcgaacactttggtcgcggtcgccatgtccgccgcgttgaacggttgcgcagaggcggtgagggcggtgctcatcgcgcaacggccacggcgctggtttccggttgcgcgcgggtgtcgacttcagcggtgacggacaggcctggacgcaagtgcccgaggacgccatcagccggatcaaggaggattcgcaccggtacacgctggacgattttggtgaagttaccggtagcgttttccggcggcagcacactgaattgcgaaccggtggcaggggcgaggctgtcgagacgaccgtggaattcctgacccgacagcacgtcggcgcggatgctcacgcgttgccctggcctcatccgcgccagttggtcttccttgaaattggcatcgacccacaacccgctggacgggaccaccgacagttgctgcgaaccggcctgcgcgtaggcgccaacccgcgcgcggcggttgccgatcaccccatcgaccggcgcgcgcagttcggtgtagccgagattcagttgcgccagatcacgttcggcgcgggcttgttgaagggcggcgcgggcctgttgtttctgggtgtcgatcaccgcgagttggcgttgcgcggcgagcagttcggcctgggcgcgggcgctcagggcttgcgcggttttgaaggtggcgtcggcacgttgtgcgctttccacggacacagcattggtggtcaccaagcgcttgtagcgcgcgttgtcatcccgcgagcgcgcggtttccgcgccggcggcgtcgatgccggcgcgggcctggccgatcaccgcttgttgcagttgttcggtggcgtcgaggttggccagcagcgcttcttcggcggcgacggcaccttcggctttggcgaggttggcgcgatagtcgcgggcgtcgagacgaatcagcacgtcgccagccttgacgtgctggttgtcgctgaccagcacttcgtcgatgtaaccggcgactttcggcccgatcaccgtgacatcgccaccaatgtaggcatcgtcggtttcttcgagaaaacgcccggcgccccaccaatgcacgacgtagaccccggcgaagatcagcgcgagcaatccgccgccgggcagcagcaagcgtttaagcaggggcggtctggtcttaaccacaacaggttcgagggtgggcatgctggtcatggcggattacctgatcaatcgggtcgttattacgactgtaatatgacgcaggtaatatttagtcgcaaatgatttttggcgccgatcgtcagttgctcatttgagccagtggcccggtgtactgccagtcatggctttgaacgcagacttgttgcggcagcgtggcgcacagttcggggatcagtagatggagcggtaatcgacactctgctgcatcaccgcgcgatggctgacacccggcgcaatccacgccgcccgcgacggcggcagcagacacaattacctgctgatcggcgtcggattgctgctcgcaggcgccgctcaagccctcggggaaacccttatagcgggtagcgccgtggtgttgctgctgacgataaagccaggtaaagcaattgtttaagaagtgtaagcgctgtaggaagcgtcttgcatttgtgtaggagggctccgactatcacgattattgatagggtggcattacgccatttgatgatcgcaaggaagttgcgtgccgttttcgtttcgcgctgtttttcgtcgttgttccacgcgttgcccgctgttgtcggcctttgtgttgagtgtctgtgcctcctcgcttgaagctgccgaacctgtcgcgccgggccaggaagtgttgcgccagcagcaacagcaacagcgcgatctgcaacaactgcaactggaacaacgcaaacgtcaactggagcgcggagctttcgggtcggcgccagcgacccctgcgctcgcaccaaccgttacccctgatgaacgttgctggccgttgagcggcacgcgcatcggtggcgtcacgctgatcgacagcgacaaactcaatgcacgcatccaaccgttgctggcgccgtgcatgggcgtcaggcagatcaatcatctgctcgcgacgatcactgcgatctacgtggaaaagggctacatcgccagccgcccgtatctgctcagcgcaccggtggcggggcaatcactggatattcgtgttgacgaaggctacatcgagtccatcgagctggccgatcagagtttgcctgtgtcccttggcggtgcgttcccgaacatgctcggcgaaccgctgaaccttcgcgatctggagcagggcctcgatcaattgaatcggctgcgctcggtagacctcaccgccgacatcgcccctggcagtgagcccggcgcctcgcggatcatcctgcgctcgcgcagcgctgcgccgtcacgctgggccttgaatgccggtatcgacaacctcggcagcgccagcaccggacgtgaccgcgacgccgtcagcctgagcctcgacagcccgctggagctcaacgatttattgagcctcagcgccagcgacacactcaatcggggcgaccgctacagtcgcaatgccagcctgtattacgcgattccttacggttactggacctacagcgcgttcgccagccacgccgaatatcgcgcgccgttcaagttgcccagcgtgacctttcacagccgcggcatcaccgatcaggtcagcctgcgtgcggaccgcgtgttgtggcgcgaccagagtcgccagctcagcgccaacctgcaattggcacacaaggatgtcgacagctatctggaaaacatccggttgggcattcagagtccgaccctgaccgtggccgaagccggactcaatctgttctggctcgaccgcgcggtgtggaacctcgacatcaactacgcccagggtttgcgctggttcggtgccgatgacgactcccggcaatcggtcaataacctgcccaaggcacagtttcgcaagtaccgcgccggcctcagtcaatggcgcaatggtcagttcggcgcgcaggtgtggcagtggcagagccagcttaacgtgcagtacagcccggacccgctaccggccatcgaacagttgctcggcaccgacgattcggcagtgcgcggttatcgcgtcagcagtgcctcgggtgccagcggtacgatctggcgcaacaccctgcgcctgccgctgcgcagcgaatggccaatacagatcaccccgcgaatgggcctcgacaacggctggatcaaagccgatcacggcgcccaggggcaacgcctcagtggcgccagcctcggtctgaatctgggctggaaaaacctgcaagtggacgtcgattaccaacgtgccctcaacacccccgacggtctgcagcacgagccgcaaacctggctgatgcgtgtcggggtgcagatatgaccgcgacctgaatcgataacgcagtgaaccaacagccgtcggaactgagcgcgtcagccacggccaagattaaaacgcgcaacgtgatgccgtactcacatggagacgtttttatgccagcacacacctttgcatttcatctttcgcctcggggcaaattgcgctgggcaatcgccagcctgttcttcgccgtgcacctgccgaacgcgatcgccggcggcgtcgtggtcgcgccggggccgggcggcaccgcgcaattgcaaacccagagcggtgtgcccatcgtcaacatcgtcgcgcccaacggttcgggcctgtcgcataaccagttcctcgactacaacgtcgaccgtcaggggcttgtgctgaacaacgccttgcaggccgggcaatcgcagctggccgggcaactggcggccaacccgcaactgcaggggcaagcggcgagcgtgatcctcaacgaagtgatcagccgtaatccgtccgcgatcaacggcgcgcaggagatcttcggccgtgccgccgattacgtgctggccaacccgaacggcatctcggtcaatggcggcagtttcatcaacacgccgaacgccaacctggtggtcggtcgtccggagctggtcgacggcaaactgcaaagcctgaacacccgcgacgccagcggtcagttgcagattcagggcggcggcctgcgtaacgctgagggctcgatcaacctgattgccccgcgtatcgacagccagggcgcgatcagtgctcgcgatagcctcaacctcacggtcggacgcaatcaggtcgattacgccagtggccaagtgaaaaccgtagacccggcgggcaacactgccgacggacgcatcgacgccagcctgttcggcgccatgcaggccggacggatcaatatcgtcagcaccgccgaaggtgccggcgtgcgcgtgggtgcggtgcaggtcgccggacgcgatggcgtgcagattcgttctgccggcgacctcacggtcagcggtgaagcgctgcccaacagccttgatgtcacccgcgccggtatccgtagcagtcacggcgatgtcggcctgcacagcggcaaagacctgaccctggccgccaccgacgtcagcggccgtgacgtgattgccgacgccagacgcaacctcaccctgaccacggtcgaaagccgcaagctccaggaaaagcgtgaaagctggaacaacagcaccatcggcatcacctgggaaacctacgaccgcacccagaccgatagtgaaacccgccagcatggcagtcagatcgttgccagccgcgacgccagactgtcgtccggcaaagacaccgaactgaaagccgccaaggtcgaagcggcgaaaaatctcagtgtgcaaagtggcggcgatctgcgcctgagcgccgccaccgaaagccatacccagaccgatcagggcaaccatcgcaagcatctgtggaaagccgactggaacaacagcagcgaagaacagcgcaatatcaccagccagttgaaggccggcaatatcgccctgcaaactgccgcgttgttgcgctccgaaggcgctgaactgaccagtaccggtgacctgcaactggccggcaaacaagtcgaaatcaccaccgccacgcggactgatcgcagcagcgacactggctattccggcgacctggtcggtggcggtttcttcggcaagaccggcgatgccgacaagggacagacccagcatcagggcagcaaaatcaacgccgccggcaagctgatcgtcaaggctgacgacgtgcgcatcagcggcagtcaagtgcgcggcggcagcgacgccagtgtgatcagcgacaagggttcgctggtgatcgatggcgtacaggacacccgccacagcaacaatcacgacaaagacagcaagttcttcggtatcagcaaagacgagtcgcggcagaacagcaatgacagcaccacggtgcgcagcgaactggtgtccgacagcaacctcaaactcaagagcgccaaagaccttgcagtggcaggctcgacggtcaaggcgggcggtgcgttaacggccgacgcggcggggaatgtcaatgtgcattccgcacaaaacactcacgacagcagtgcgatcactgaaacgcgtggctttgatgcctacgccaaagagcagacgccagagcaatatcgtgccggcgttcactacgaagccaaacagcagacagtgaccagcaccgacgtcactcagcaagcttccagcctcag

(The sequence listing continues in the following parts.)

The invention claimed is:

1. A composition comprising:
    (a) a species of genus *Pseudomonas* identified as *Pseudomonas* BR11571, having Accession Deposit Number DSM 32538 in amounts effective to facilitate the solubilization of precious metals by releasing biogenic substances;
    (b) at least one solid material; and
    (c) at least one amino acid.

2. The species according to claim 1, wherein said species belongs to risk group 1.

3. The species according to claim 1, wherein the ribosomal DNA of said species has SEQ ID No. 1.

4. The species according to claim 1, wherein said species is capable of producing biogenic substances.

5. A method comprising using a species of genus *Pseudomonas* identified as *Pseudomonas* BR11571, having Accession Deposit Number DSM 32538 for extracting precious metals from solid materials.

6. The method according to claim 5, wherein the solid material is a secondary resource.

7. The method according to claim 6, wherein the secondary resource is selected from the group consisting of fly ashes, waste incineration ashes, metal scoriae and electronic scraps.

8. The method according to claim 5, wherein the precious metals are selected from the group consisting of gold, silver, platinum, palladium, rhodium, iridium, copper and their mixtures.

9. The method according to claim 5, wherein the species produces biogenic substances which facilitate the solubilization of precious metals from solid materials.

10. The method according to claim 9, wherein the species produces biogenic substances in the presence of amino acids.

11. The method according to claim 9, wherein the biogenic substance comprises hydrocyanic acid.

12. The composition according to claim 1, wherein the at least one solid material (b) is selected from the group consisting of fly ashes, waste incineration ashes, metal scoriae and electronic scraps.

13. The composition according to claim 1, wherein the precious metals are selected from the group consisting of gold, silver, platinum, palladium, rhodium, iridium, copper and their mixtures.

14. The composition according to claim 1, wherein the at least one amino acid (c) is glycine.

* * * * *